US011474105B2

(12) United States Patent
Young et al.

(10) Patent No.: US 11,474,105 B2
(45) Date of Patent: Oct. 18, 2022

(54) METHODS AND COMPOSITIONS FOR SIRT1 EXPRESSION AS A MARKER FOR ENDOMETRIOSIS AND SUBFERTILITY

(71) Applicants: The University of North Carolina at Chapel Hill, Chapel Hill, NC (US); Upstate Affiliate Organization, Greenville, SC (US); Board of Trustees of Michigan State University, East Lansing, MI (US)

(72) Inventors: Steven L. Young, Durham, NC (US); Bruce Arthur Lessey, Greenville, SC (US); Jae Wook Jeong, Grand Rapids, MI (US)

(73) Assignees: The University of North Carolina at Chapel Hill, Chapel Hill, NC (US); Upstate Affiliate Organization, Greenville, SC (US); Board of Trustees of Michigan State University, East Lansing, MI (US)

( * ) Notice: Subject to any disclaimer, the term of this patent is extended or adjusted under 35 U.S.C. 154(b) by 0 days.

(21) Appl. No.: 16/090,066

(22) PCT Filed: Mar. 31, 2017

(86) PCT No.: PCT/US2017/025339
§ 371 (c)(1),
(2) Date: Sep. 28, 2018

(87) PCT Pub. No.: WO2017/173250
PCT Pub. Date: Oct. 5, 2017

(65) Prior Publication Data
US 2020/0018761 A1 Jan. 16, 2020

Related U.S. Application Data
(60) Provisional application No. 62/471,815, filed on Mar. 15, 2017, provisional application No. 62/316,163, filed on Mar. 31, 2016.

(51) Int. Cl.
*C07K 16/40* (2006.01)
*G01N 33/68* (2006.01)
*G01N 33/574* (2006.01)

(52) U.S. Cl.
CPC ....... *G01N 33/57449* (2013.01); *C07K 16/40* (2013.01); *G01N 33/689* (2013.01); *G01N 33/6872* (2013.01); *C07K 2317/34* (2013.01); *G01N 2333/98* (2013.01)

(58) Field of Classification Search
None
See application file for complete search history.

(56) References Cited

U.S. PATENT DOCUMENTS

| | | | |
|---|---|---|---|
| 4,981,785 A | 1/1991 | Nayak | |
| 5,358,691 A | 10/1994 | Clark et al. | |
| 5,478,725 A | 12/1995 | Lessey | |
| 5,599,677 A | 2/1997 | Dowell et al. | |
| 5,672,480 A | 9/1997 | Dowell et al. | |
| 5,885,530 A | 3/1999 | Babson et al. | |
| 6,159,750 A | 12/2000 | Edmonds | |
| 7,871,778 B2 | 1/2011 | Giudice | |
| 8,247,174 B2 | 8/2012 | Giudice | |
| 2003/0113746 A1 | 6/2003 | Leyendecker | |
| 2004/0152141 A1 | 8/2004 | Lessey | |
| 2005/0164272 A1 | 7/2005 | Warrington et al. | |
| 2011/0171631 A1 | 7/2011 | Giudice | |
| 2014/0024590 A1 | 1/2014 | Weidhaas et al. | |
| 2014/0287948 A1* | 9/2014 | Boniface | G01N 33/689 506/9 |

FOREIGN PATENT DOCUMENTS

WO 2007057648 5/2007
WO 2015143228 9/2015

OTHER PUBLICATIONS

Vaquero et al., Molecular Cell, 2004; 16: 93-105 (Year: 2004).*
Chamdin et al., Translational Oncology, 2009; 2: 128-137 (Year: 2009).*
Taguchi et al., J. Obstet. Gynaecol. Res. 2014; 40: 770-778 (Year: 2014).*
Tatone et al. (Human Reproduction Update, 2018; 24: 267-289 (Year: 2018).*
Jafarlou et al., Journal of Biological Regulators & Homeostatic Agents, 2016: 30: 315-321 (Year: 2016).*
Piche-Nicholas et al., MAbs. 2018; 10: 81-94. doi: 10.1080/19420862.2017.1389355 (Year: 2018).*
Lessey et al., Reproductive Sciences, (Mar. 2015) vol. 22, Supp. 1, pp. 223A. Abstract No. F-058; presented between Mar. 25, 2015-Mar. 28, 2015 (Year: 2015).*

(Continued)

*Primary Examiner* — Christina M Borgeest
(74) *Attorney, Agent, or Firm* — Myers Bigel, P.A.

(57) ABSTRACT

The present invention provides a method of diagnosing endometriosis and/or infertility in a subject, comprising: a) obtaining a sample from the subject; b) detecting a level of expression of a SIRT1 gene and/or protein in the sample; c) detecting a level of expression of a BCL6 gene and/or protein in the sample; d) comparing the level of expression detected in (b) with the level of expression of a SIRT1 gene and/or protein in a sample obtained from a control subject or a population of control subjects; e) comparing the level of expression detected in (c) with the level of expression of a BCL6 gene and/or protein in a sample obtained from a control subject or a population of control subjects; and f) diagnosing the subject as having infertility when the subject has a level of expression of the SIRT1 gene and/or protein greater than the level of expression of the SIRT1 gene and/or protein of the control subject or population of control subjects and also has a level of expression of the BCL6 gene and/or protein that is greater than the level of expression of the BCL6 gene and/or protein of the control subject or population of control subjects.

15 Claims, 15 Drawing Sheets

Specification includes a Sequence Listing.

(56) References Cited

OTHER PUBLICATIONS

Blackhall et al., J Clin Oncol. 2014; 32: 2780-2787 (Year: 2014).*
Guo et al., Acta Biochim Biophys Sin (2008): 426-436 (Year: 2008).*
Bartosch et al., Oncotarget, 2015, 7: 1144-1154 (Year: 2015).*
Adamson et al. "Creating solutions in endometriosis: global collaboration through the World Endometriosis Research Foundation" Journal of Endometriosis, 2(1):3-6 (2010).
Aghajanova et al. "Altered gene expression profiling in endometrium: evidence for progesterone resistance" Seminars in Reproductive Medicine, 28:51-58 (2010) (Abstract Only).
AHN et al. "cAMP-Response Element-Binding 3-like protein 1 (CREB3L1) is required for decidualization and its expression is decreased in women with endometriosis" Current Molecular Medicine, 6(3):276-287 (2016).
Arici et al. "The effect of endometriosis on implantation: results from the Yale University in vitro fertilization and embryo transfer program" Fertility and Sterility, 65:603-607 (1996).
Barnhart et al. "Effect of endometriosis on in vitro fertilization" Fertility and Sterility, 77:1148-1155 (2002).
Bird et al. "Single-chain antigen-binding proteins" Science, 242:423-426 (1988) (Abstract Only).
Budwit-Novotny et al. "Immunohistochemical analyses of estrogen receptor in endometrial adenocarcinoma using a monoclonal antibody" Cancer Research, 46:5419-5425 (1986).
Burney et al. "MicroRNA expression profiling of eutopic secretory endometrium in women with versus without endometriosis" Molecular Human Reproduction, 15:625-631 (2009).
Cardenas et al. "Rationally designed BCL6 inhibitors target activated B cell diffuse large B cell lymphoma" The Journal of Clinical Investigation, 126(9):3351-3362 (2016).
Cerchietti et al. "Targeting BCL-6 in Diffuse Large B-Cell Lymphoma: What Does This Mean for the Future Treatment?" Expert Review of Hematology, 6(4):343-345 (2013).
Chang et al. "Overexpression of Four Joint Box-1 Protein (FJX1) in Eutopic Endometrium From Women With Endometriosis" Reproductive Sciences, 25(2):207-213 (2018).
Chaouat et al. "Cytokines: Important for implantation?" The Journal of Assisted Reproduction and Genetics, 24:491-505 (2007).
Creus et al. "alpha v beta 3 integrin expression and pinopod formation in normal and out-of-phase endometria of fertile and infertile women" Human Reproduction, 17:2279-2286 (2002).
Evans-Hoeker et al. "Endometrial BCL6 Overexpression in Eutopic Endometrium of Women With Endometriosis" Reproductive Sciences, 23(9):1234-1241 (2016).
Franasiak et al. "Prospective assessment of midsecretory endometrial leukemia inhibitor factor expression versus a?β3 testing in women with unexplained infertility" Fertility and Sterility, 101:1724-1731 (2014).
GenBank Accession No. AAA35927 "plate glycoprotein IIIa (GPIIIa) [Homo sapiens]" NCBI (2 pages) (Jun. 11, 1993).
GenBank Accession No. AAD51953 "glycoprotein IIIa [Sus scrofa]" NCBI (2 pages) (Aug. 31, 1999).
GenBank Accession No. AAI66425 "B-cell CLL/lymphoma 6 [Rattus norvegicus]" NCBI (3 pages) (Mar. 18, 2009).
GenBank Accession No. AF170527 "Sus scrofa glycoprotein IIIa (GPIIIa) mRNA, complete cds" NCBI (2 pages) (Aug. 31, 1999).
GenBank Accession No. AK036975 "*Mus musculus* adult female vagina cDNA, RIKEN full-length enriched library, clone:9930032A10 product:B-cell leukemia/lymphoma 6, full insert sequence" NCBI (4 pages) (Oct. 6, 2010).
GenBank Accession No. AK039228 "*Mus musculus* adult male spinal cord cDNA, RIKEN full-length enriched library, clone:A330001J07 product:B-cell leukemia/lymphoma 6, full insert sequence" NCBI (4 pages) (Oct. 6, 2010).
GenBank Accession No. BAC29654 "unnamed protein product [Mus musculus]" NCBI (5 pages) (Oct. 6, 2010).
GenBank Accession No. BAC30286 "unnamed protein product [Mus musculus]" NCBI (5 pages) (Oct. 6, 2010).
GenBank Accession No. BC166425 "Rattus norvegicus B-cell CLL/lymphoma 6, mRNA (cDNA clone MGC:187400 IMAGE:7097735), complete cds" NCBI (3 pages) (Mar. 18, 2009).
GenBank Accession No. M35999 "Human platelet glycoprotein IIIa (GPIIIa) mRNA, complete cds" NCBI (2 pages) (Jun. 11, 1993).
GenBank Accession No. NM_000212 "*Homo sapiens* integrin subunit beta 3 (ITGB3), mRNA" NCBI (7 pages) (Jun. 4, 2017).
GenBank Accession No. NM_001003162 "Canis lupus familiaris integrin subunit beta 3 (ITGB3), mRNA" NCBI (2 pages) (Aug. 9, 2016).
GenBank Accession No. NM_001081802 "Equus caballus integrin subunit beta 3 (ITGB3), mRNA" NCBI (2 pages) (Aug. 9, 2016).
GenBank Accession No. NM_001107084 "Rattus norvegicus B-cell CLL/lymphoma 6 (Bcl6), mRNA" NCBI (3 pages) (Jun. 25, 2017).
GenBank Accession No. NM_001159790 "Pongo abelii B-cell CLL/lymphoma 6 (BCL6), mRNA" NCBI (2 pages) (Apr. 18, 2013).
GenBank Accession No. NM_001206450 "Bos taurus B-cell CLL/lymphoma 6 (BCL6), mRNA" NCBI (3 pages) (Apr. 24, 2016).
GenBank Accession No. NM_001206490 "Bos taurus integrin subunit beta 3 (ITGB3), mRNA" NCBI (4 pages) (Sep. 1, 2016).
GenBank Accession No. NM_009744 "Mus musculus B cell leukemia/lymphoma 6 (Bcl6), transcript variant 1, mRNA" NCBI (5 pages) (Jun. 26, 2017).
GenBank Accession No. NM_214002 "Sus scrofa integrin subunit beta 3 (ITGB3), mRNA" NCBI (4 pages) (Aug. 9, 2016).
GenBank Accession No. NP_000203 "integrin beta-3 precursor [*Homo sapiens*]" NCBI (4 pages) (Jun. 4, 2017).
GenBank Accession No. NP 001003162 "integrin beta-3 precursor [Canis lupus familiaris]" NCBI (2 pages) (Aug. 9, 2016).
GenBank Accession No. NP_001075271 "integrin beta-3 precursor [Equus caballus]" NCBI (2 pages) (Aug. 9, 2016).
GenBank Accession No. NP_001100554 "B-cell lymphoma 6 protein [Rattus norvegicus]" NCBI (3 pages) (Jun. 25, 2017).
GenBank Accession No. NP_001153262 "B-cell lymphoma 6 protein [Pongo abelii]" NCBI (2 pages) (Apr. 18, 2013).
GenBank Accession No. NP_001193379 "B-cell lymphoma 6 protein [Bos Taurus]" NCBI (3 pages) (Apr. 24, 2016).
GenBank Accession No. NP_001193419 "integrin beta-3 precursor [Bos taurus]" NCBI (2 pages) (Sep. 1, 2016).
GenBank Accession No. NP_033874 "B-cell lymphoma 6 protein homolog [Mus musculus]" NCBI (4 pages) (Jun. 26, 2017).
GenBank Accession No. NP_999167 "integrin beta-3 precursor [Sus scrofa]" NCBI (3 pages) (Aug. 9, 2016).
GenBank Accession No. XM_001116013 "PREDICTED: Macaca mulatta integrin, beta 3 (platelet glycoprotein IIIa, antigen CD61), transcript variant 2 (ITGB3), mRNA" NCBI (3 pages) (Jun. 1, 2010).
GenBank Accession No. XM_001158812 "PREDICTED: Pan troglodytes B-cell CLL/lymphoma 6 (BCL6), transcript variant X2, mRNA" NCBI (3 pages) (Jun. 2, 2016).
GenBank Accession No. XM_001499782 "PREDICTED: Equus caballus B-cell CLL/lymphoma 6 (BCL6), transcript variant X2, mRNA" NCBI (2 pages) (Nov. 20, 2015).
GenBank Accession No. XM_002834317 "PREDICTED: Pongo abelii integrin, beta 3 (platelet glycoprotein IIIa, antigen CD61) (ITGB3), transcript variant X1, mRNA" NCBI (2 pages) (Sep. 23, 2014).
GenBank Accession No. XM_003363354 "PREDICTED: Equus caballus B-cell CLL/lymphoma 6 (BCL6), transcript variant X1, mRNA" NCBI (3 pages) (Nov. 20, 2015).
GenBank Accession No. XM_003824955 "PREDICTED: Pan paniscus B-cell CLL/lymphoma 6 (BCL6), transcript variant X1, mRNA" NCBI (3 pages) (Sep. 30, 2015).
GenBank Accession No. XM_003927003 "PREDICTED: Saimiri boliviensis boliviensis B-cell CLL/lymphoma 6 (BCL6), transcript variant X1, mRNA" NCBI (3 pages) ( Nov. 24, 2014).
GenBank Accession No. XM_003991804 "PREDICTED: Felis catus B-cell CLL/lymphoma 6 (BCL6), transcript variant X1, mRNA" NCBI (2 pages) (Dec. 29, 2016).
GenBank Accession No. XM_003997035 "PREDICTED: Felis catus integrin subunit beta 3 (ITGB3), transcript variant X2, mRNA" NCBI (3 pages) (Dec. 29, 2016).

(56) References Cited

OTHER PUBLICATIONS

GenBank Accession No. XM_004038190 "PREDICTED: Gorilla gorilla gorilla B-cell CLL/lymphoma 6 (BCL6), transcript variant X1, mRNA" NCBI (3 pages) (Nov. 4, 2016).
GenBank Accession No. XM_004041453 "PREDICTED: Gorilla gorilla gorilla integrin subunit beta 3 (ITGB3),mRNA" NCBI (2 pages) (Nov. 4, 2016).
GenBank Accession No. XM_004275670 "PREDICTED: Orcinus orca integrin, beta 3 (platelet glycoprotein IIIa, antigen CD61) (ITGB3), mRNA" NCBI (3 pages) (May 15, 2015).
GenBank Accession No. XM_004275671 "PREDICTED: Orcinus orca integrin, beta 3 (platelet glycoprotein IIIa, antigen CD61), transcript variant 2 (ITGB3), mRNA" NCBI (2 pages) (Mar. 18, 2013).
GenBank Accession No. XM_004278481 "PREDICTED: Orcinus orca B-cell CLL/lymphoma 6, transcript variant 1 (BCL6), mRNA" NCBI (3 pages) (Mar. 18, 2013).
GenBank Accession No. XM_004278482 "PREDICTED: Orcinus orca B-cell CLL/lymphoma 6 (BCL6), transcript variant X2, mRNA" NCBI (3 pages) (May 15, 2015).
GenBank Accession No. XM_005201513 "PREDICTED: Bos taurus B-cell CLL/lymphoma 6 (BCL6), transcript variant X1, mRNA" NCBI (2 pages) (Jan. 26, 2016).
GenBank Accession No. XM_005584610 "PREDICTED: Macaca fascicularis integrin subunit beta 3 (ITGB3), mRNA" NCBI (2 pages) (Jan. 25, 2016).
GenBank Accession No. XM_005601882 "PREDICTED: Equus caballus B-cell CLL/lymphoma 6 (BCL6), transcript variant X3, mRNA" NCBI (3 pages) (Nov. 20, 2015).
GenBank Accession No. XM_005624174 "PREDICTED: Canis lupus familiaris integrin, beta 3 (platelet glycoprotein IIIa, antigen CD61) (ITGB3), transcript variant X1, mRNA" NCBI, (3 pages) (Sep. 17, 2015).
GenBank Accession No. XM_005639719 "PREDICTED: Canis lupus familiaris B-cell CLL/lymphoma 6 (BCL6), transcript variant X1, mRNA" NCBI (3 pages) (Sep. 17, 2015).
GenBank Accession No. XM_005639720 "PREDICTED: Canis lupus familiaris B-cell CLL/lymphoma 6 (BCL6), transcript variant X2, mRNA" NCBI (3 pages) (Sep. 17, 2015).
GenBank Accession No. XM_005639722 "PREDICTED: Canis lupus familiaris B-cell CLL/lymphoma 6 (BCL6), transcript variant X3, mRNA" NCBI (3 pages) (Sep. 17, 2015).
GenBank Accession No. XM_006936189 "PREDICTED: Felis catus B-cell CLL/lymphoma 6 (BCL6), transcript variant X2, mRNA" NCBI (3 pages) (Dec. 29, 2016).
GenBank Accession No. XM_006936190 "PREDICTED: Felis catus B-cell CLL/lymphoma 6 (BCL6), transcript variant X3, mRNA" NCBI (2 pages) (Dec. 29, 2016).
GenBank Accession No. XM_008009503 "PREDICTED: Chlorocebus sabaeus B-cell CLL/lymphoma 6 (BCL6), transcript variant X1, mRNA" NCBI (3 pages) (May 14, 2014).
GenBank Accession No. XM_008009504 "PREDICTED: Chlorocebus sabaeus B-cell CLL/lymphoma 6 (BCL6), transcript variant X2, mRNA" NCBI (3 pages) (May 14, 2014).
GenBank Accession No. XM_008009507 "PREDICTED: Chlorocebus sabaeus B-cell CLL/lymphoma 6 (BCL6), transcript variant X4, mRNA" NCBI (4 pages) (May 14, 2014).
GenBank Accession No. XM_008012292 "PREDICTED: Chlorocebus sabaeus integrin, beta 3 (platelet glycoprotein IIIa, antigen CD61) (ITGB3), transcript variant X1,mRNA" NCBI (3 pages) (May 14, 2014).
GenBank Accession No. XM_008012293 "PREDICTED: Chlorocebus sabaeus integrin, beta 3 (platelet glycoprotein IIIa, antigen CD61) (ITGB3), transcript variant X2, mRNA" NCBI (3 pages) (May 14, 2014).
GenBank Accession No. XM_008768799 "PREDICTED: Rattus norvegicus B-cell CLL/lymphonna 6 (Bcl6), transcript variant X1, mRNA" NCBI (3 pages) (Aug. 7, 2014).
GenBank Accession No. XM_008961749 "PREDICTED: Pan paniscus integrin, beta 3 (platelet glycoprotein IIIa, antigen CD61) (ITGB3), mRNA" NCBI (2 pages) (Sep. 30, 2015).
GenBank Accession No. XM_008978646 "PREDICTED: Pan paniscus B-cell CLL/lymphoma 6 (BCL6), transcript variant X2, mRNA" NCBI (3 pages) (Sep. 30, 2015).
GenBank Accession No. XM_008978648 "PREDICTED: Pan paniscus B-cell CLL/lymphoma 6 (BCL6), transcript variant X4, mRNA" NCBI (5 pages) (Sep. 30, 2015).
GenBank Accession No. XM_009236637 "PREDICTED: Pongo abelii integrin, beta 3 (platelet glycoprotein IIIa, antigen CD61) (ITGB3), transcript variant X2, mRNA" NCBI (2 pages) (Sep. 23, 2014).
GenBank Accession No. XM_009446989 "PREDICTED: Pan troglodytes B-cell CLL/lymphoma 6 (BCL6), transcript variant X1, mRNA" NCBI (4 pages) (Jun. 2, 2016).
GenBank Accession No. XM_009446993 "PREDICTED: Pan troglodytes B-cell CLL/lymphoma 6 (BCL6), transcript variant X7, mRNA" NCBI (3 pages) (Jun. 2, 2016).
GenBank Accession No. XM_010330277 "PREDICTED: Saimiri boliviensis boliviensis integrin, beta 3 (platelet glycoprotein IIIa, antigen CD61) (ITGB3), transcript variant X1, mRNA" NCBI (2 pages) (Nov. 24, 2014).
GenBank Accession No. XM_010330278 "PREDICTED: Saimiri boliviensis boliviensis integrin, beta 3 platelet glycoprotein IIIa, antigen CD61) (ITGB3), transcript variant X2, RNA" NCBI (2 pages) (Nov. 24, 2014).
GenBank Accession No. XM_010337712 "PREDICTED: Saimiri boliviensis boliviensis B-cell CLL/lymphoma 6 (BCL6), transcript variant X2, mRNA" NCBI (4 pages) (Nov. 24, 2014).
GenBank Accession No. XM_010337713 "PREDICTED: Saimiri boliviensis boliviensis B-cell CLL/lymphonna 6 (BCL6), transcript variant X3, mRNA" NCBI (3 pages) (Nov. 24, 2014).
GenBank Accession No. XM_523684 "PREDICTED: Pan troglodytes integrin subunit beta 3 (ITGB3), transcript variant X1, mRNA" NCBI (3 pages) (Jun. 2, 2016).
GenBank Accession No. XP_001116013 "PREDICTED: integrin beta-3-like isoform 2 [Macaca mulatta]" NCBI (2 pages) (Jun. 1, 2010).
GenBank Accession No. XP_001158812 "PREDICTED: B-cell lymphoma 6 protein [Pan troglodytes]" NCBI (3 pages) (Jun. 2, 2016).
GenBank Accession No. XP_001499832 "PREDICTED: B-cell lymphoma 6 protein isoform X1 [Equus caballus]" NCBI (3 pages) (Nov. 20, 2015).
GenBank Accession No. XP_002834363 "PREDICTED: integrin beta-3 isoform X1 [Pongo abelii]" NCBI (2 pages) (Sep. 23, 2014).
GenBank Accession No. XP_003363402 "PREDICTED: B-cell lymphoma 6 protein isoform X1 [Equus caballus]" NCBI (3 pages) (Nov. 20, 2015).
GenBank Accession No. XP_003825003 "PREDICTED: B-cell lymphoma 6 protein [Pan paniscus]" NCBI (3 pages) (Sep. 30, 2015).
GenBank Accession No. XP_003927052 "PREDICTED: B-cell lymphoma 6 protein [Saimiri boliviensis boliviensis]"NCBI (3 pages) (Nov. 24, 2014).
GenBank Accession No. XP_003991853 "PREDICTED: B-cell lymphoma 6 protein [Felis catus]" NCBI (3 pages) (Dec. 29, 2016).
GenBank Accession No. XP_003997084 "PREDICTED: integrin beta-3 isoform X2 [Felis catus]" NCBI (2 pages) (Dec. 29, 2016).
GenBank Accession No. XP_004038238 "PREDICTED: B-cell lymphoma 6 protein isoform X1 [Gorilla gorilla gorilla]"NCBI (3 pages) (Nov. 4, 2016).
GenBank Accession No. XP_004041501 "PREDICTED: integrin beta-3 [Gorilla gorilla gorilla]" NCBI (2 pages) (Nov. 4, 2016).
GenBank Accession No. XP_004275718 "PREDICTED: integrin beta-3 [Orcinus orca]" NCBI (2 pages) (May 15, 2015).
GenBank Accession No. XP_004275719 "PREDICTED: integrin beta-3 isoform 2 [Orcinus orca]" NCBI (2 pages) (Mar. 18, 2013).
GenBank Accession No. XP_004278529 "PREDICTED: B-cell lymphoma 6 protein isoform 1 [Orcinus orca]" NCBI (2 pages) (Mar. 18, 2013).

(56) References Cited

OTHER PUBLICATIONS

GenBank Accession No. XP_004278530 "PREDICTED: B-cell lymphoma 6 protein [Orcinus orca]" NCBI (3 pages) (May 15, 2015).
GenBank Accession No. XP_005201570 "PREDICTED: B-cell lymphoma 6 protein isoform X1 [Bos taurus]" NCBI (3 pages) (Jan. 26, 2016).
GenBank Accession No. XP_005584667 "PREDICTED: integrin beta-3 [Macaca fascicularis]" NCBI (2 pages) (Jan. 25, 2016).
GenBank Accession No. XP_005601939 "PREDICTED: B-cell lymphoma 6 protein isoform X1 [Equus caballus]" NCBI (3 pages) (Nov. 20, 2015).
GenBank Accession No. XP_005624231 "PREDICTED: integrin beta-3 isoform X1 [Canis lupus familiaris]" NCBI (2 pages) (Sep. 17, 2015).
GenBank Accession No. XP_005639776 "PREDICTED: B-cell lymphoma 6 protein isoform X1 [Canis lupus familiaris]" NCBI (3 pages) (Sep. 17, 2015).
GenBank Accession No. XP_005639777 "PREDICTED: B-cell lymphoma 6 protein isoform X1 [Canis lupus familiaris]" NCBI (3 pages) (Sep. 17, 2015).
GenBank Accession No. XP_005639779 "PREDICTED: B-cell lymphoma 6 protein isoform X1 [Canis lupus familiaris]" NCBI (3 pages) (Sep. 17, 2015).
GenBank Accession No. XP_006936251 "PREDICTED: B-cell lymphoma 6 protein [Felis catus]" NCBI (3 pages) (Dec. 29, 2016).
GenBank Accession No. XP_006936252 "PREDICTED: B-cell lymphoma 6 protein [Felis catus]" NCBI (3 pages) (Dec. 29, 2016).
GenBank Accession No. XP_008007694 "PREDICTED: B-cell lymphoma 6 protein [Chlorocebus sabaeus]" NCBI (3 pages) (May 14, 2014).
GenBank Accession No. XP_008007695 "PREDICTED: B-cell lymphoma 6 protein [Chlorocebus sabaeus]" NCBI (3 pages) (May 14, 2014).
GenBank Accession No. XP_008007698 "PREDICTED: B-cell lymphoma 6 protein [Chlorocebus sabaeus]" NCBI (3 pages) (May 14, 2014).
GenBank Accession No. XP_008010483 "PREDICTED: integrin beta-3 isoform X1 [Chlorocebus sabaeus]" NCBI (2 pages) (May 14, 2014).
GenBank Accession No. XP_008010484 "PREDICTED: integrin beta-3 isoform X2 [Chlorocebus sabaeus]" NCBI (2 pages) (May 14, 2014).
GenBank Accession No. XP_008767021 "PREDICTED: B-cell lymphoma 6 protein isoform X1 [Rattus norvegicus]" NCBI (2 pages) (Aug. 7, 2014).
GenBank Accession No. XP_008959997 "PREDICTED: integrin beta-3 [Pan paniscus]" NCBI (2 pages) (Sep. 30, 2015).
GenBank Accession No. XP_008976894 "PREDICTED: B-cell lymphoma 6 protein [Pan paniscus]" NCBI (3 pages) (Sep. 30, 2015).
GenBank Accession No. XP_008976896 "PREDICTED: B-cell lymphoma 6 protein [Pan paniscus]" NCBI (3 pages) (Sep. 30, 2015).
GenBank Accession No. XP_009234912 "PREDICTED: integrin beta-3 isoform X2 [Pongo abelii]" NCBI (2 pages) (Sep. 23, 2014).
GenBank Accession No. XP_009445264 "Predicted: B-cell lymphoma 6 protein [Pan troglodytes]" NCBI (3 pages) (Jun. 2, 2016).
GenBank Accession No. XP_009445268 "PREDICTED: B-cell lymphoma 6 protein [Pan troglodytes]" NCBI (3 pages) (Jun. 2, 2016).
GenBank Accession No. XP_010328579 "PREDICTED: integrin beta-3 isoform X1 [Saimiri boliviensis boliviensis]"NCBI (2 pages) (Nov. 24, 2014).
GenBank Accession No. XP_010328580 "PREDICTED: integrin beta-3 isoform X2 [Saimiri boliviensis boliviensis]"NCBI (2 pages) (Nov. 24, 2014).
GenBank Accession No. XP_010336014 "PREDICTED: B-cell lymphoma 6 protein [Saimiri boliviensis boliviensis]"NCBI (3 pages) (Nov. 24, 2014).
GenBank Accession No. XP_010336015 "PREDICTED: B-cell lymphoma 6 protein [Saimiri boliviensis boliviensis]"NCBI (3 pages) (Nov. 24, 2014).
GenBank Accession No. XP_523684 "PREDICTED: integrin beta-3 isoform X1 [Pan troglodytes]" NCBI (2 pages) (Jun. 2, 2016).
Giudice, Linda C. "Clinical Practice. Endometriosis" The New England Journal of Medicine, 362:2389-2398 (2010).
Hahn et al. "Experimental evidence for failure to implant as a mechanism of infertility associated with endometriosis" American Journal of Obstetrics and Gynecology, 155:1109-1113 (1986) (Abstract Only).
Holoch et al. "Endometriosis and Infertility" Clinical Obstetrics and Gynecology, 53:429-438 (2010) (Abstract Only).
Hunkapiller et al. "The growing immunoglobulin gene superfamily" Nature, 323:15-16 (1986).
Huston et al. "Protein engineering of antibody binding sites: recovery of specific activity in an anti-digoxin single-chain Fv analogue produced in *Escherichia coli*." Proceedings of the National Academy of Sciences USA, 85:5879-5883 (1988).
International Preliminary Report on Patentability corresponding to International Patent Application No. PCT/US2017/025339 (8 pages) (dated Oct. 11, 2018).
Irwin et al. "Growth factors and decidualization in vitro" Annals of the New York Academy of Sciences, 734:7-18 (1994).
Jeong et al. "Mig-6 modulates uterine steroid hormone responsiveness and exhibits altered expression in endometrial disease" Proceedings of the National Academy of Sciences USA, 106(21):8677-8682 (2009.
Joshi et al. "Altered expression of microRNA-451 in eutopic endometrium of baboons (Papio anubis) with endometriosis" Human Reproduction, 30(12):2881-2891 (2015).
Joshi et al. "Progesterone Resistance in Endometriosis Is Modulated by the Altered Expression of MicroRNA-29c and FKBP4" The Journal of Clinical Endocrinology and Metabolism, 102(1):141-149 (2017).
Kim et al. "Aberrant activation of signal transducer and activator of transcription-3 (STAT3) signaling in endometriosis" Human Reproduction, 30(5):1069-1078 (2015).
Kim et al. "ARID1A Is Essential for Endometrial Function during Early Pregnancy" PLoS Genetics, 11(9):e1005537 (2015).
Kojima et al. "Testicular germ cell apoptosis in Bcl6-deficient mice" Development, 128:57-65 (2001).
Kumagai et al. "The proto-oncogene Bcl6 inhibits apoptotic cell death in differentiation-induced mouse myogenic cells" Oncogene, 18:467-475 (1999).
Lanzavecchia et al. "The use of hybrid hybridomas to target human cytotoxic T lymphocytes" European Journal of Immunology, 17:105-111 (1987).
Large et al. "The regulation of embryo implantation and endometrial decidualization by progesterone receptor signaling" Molecular and Cellular Endocrinology, 358:155-165 (2012) (Abstract Only).
Lessey et al. "Integrin adhesion molecules in the human endometrium. Correlation with the normal and abnormal menstrual cycle" Journal of Clinical Investigation, 90:188-195 (1992).
Lessey et al. "Aberrant integrin expression in the endometrium of women with endometriosis" The Journal of Clinical Endocrinology and Metabolism, 79:643-649 (1994) (Abstract Only).
Lessey et al. "Further characterization of endometrial integrins during the menstrual cycle and in pregnancy" Fertility and Sterility, 62:497-506 (1994).
Lessey et al. "Integrins as markers of uterine receptivity in women with primary unexplained infertility" Fertility and Sterility, 63:535-542 (1995).
Lessey et al. "Eutopic endometrium in women with endometriosis: ground zero for the study of implantation defects" Seminars in Reproductive Medicine, 31:109-124 (2013) (Abstract Only).
Lessey et al. "Homeostasis imbalance in the endometrium of women with implantation defects: the role of estrogen and progesterone" Seminars in Reproductive Medicine, 32:365-375 (2014) (Abstract Only).
Li et al. "COUP-TFII Regulates Human Endometrial Stromal Genes Involved in Inflammation" Molecular Endocrinology, 27(12):2041-2054 (2013).

(56) References Cited

OTHER PUBLICATIONS

Meyer et al. "Hydrosalpinges adversely affect markers of endometrial receptivity" Human Reproduction, 12:1393-1398 (1997).
Miller et al. "Endometrial receptivity defects during IVF cycles with and without letrozole" Human Reproduction, 27:881-888 (2012).
Navot et al. "An insight into early reproductive processes through the in vivo model of ovum donation" The Journal of Clinical Endocrinology and Metabolism, 72:408-414 (1991) (Abstract Only).
Noyes et al. "Dating the endometrial biopsy" Fertility and Sterility, 1:3-25 (1950).
Olive et al. "Endometriosis" The New England Journal of Medicine, 328:1759-1769 (1993) (Abstract Only).
Phillips, Anthony J. "The challenge of gene therapy and DNA delivery" Journal of Pharmacy and Pharmacology, 53:1169-1174 (2001).
Pirollo et al. "Targeted Delivery of Small Interfering RNA: Approaching Effective Cancer Therapies" Cancer Research, 68(5):1247-1250 (2008).
Plante et al. "G protein-coupled estrogen receptor (GPER) expression in normal and abnormal endometrium" Reproductive Sciences, 19:684-693 (2012).
Popovici et al. "Discovery of new inducible genes in in vitro decidualized human endometrial stromal cells using microarray technology" Endocrinology, 141:3510-3513 (2000).
Ryan et al. "Isolation, characterization, and comparison of human endometrial and endometriosis cells in vitro" The Journal of Clinical Endocrinology & Metabolism, 78:642-649 (1994) (Abstract Only).
Savaris et al. "Progesterone Resistance in PCOS Endometrium: A Microarray Analysis in Clomiphene Citrate-Treated and Artificial Menstrual Cycles" The Journal of Clinical Endocrinology & Metabolism, 96(6):1737-1746 (2011).
Shaffer et al. "BCL6 represses genes that function in lymphocyte differentiation, inflammation, and cell cycle control" Immunity, 13:199-212 (2000).
Simon et al. "Outcome of patients with endometriosis in assisted reproduction: results from in-vitro fertilization and oocyte donation" Human Reproduction, 9:725-729 (1994).
Strathy et al. "Endometriosis and infertility: a laparoscopic study of endometriosis among fertile and infertile women" Fertility and Sterility, 38:667-672 (1982).
Su et al. "Decreased Notch Pathway Signaling in the Endometrium of Women With Endometriosis Impairs Decidualization" The Journal of Clinical Endocrinology & Metabolism, 100(3):E433-E442 (2015).
Takeda et al. "Bcl6 is a transcriptional repressor for the IL-18 gene" Journal of Immunology, 171:426-431 (2003).
Talbi et al. "Molecular phenotyping of human endometrium distinguishes menstrual cycle phases and underlying biological processes in normo-ovulatory women" Endocrinology, 147:1097-1121 (2006).
Tiberi et al. "A BCL6/BCOR/SIRT1 Complex Triggers Neurogenesis and Suppresses Medulloblastoma by Repressing Sonic Hedgehog Signaling" Cancer Cell, 26:797-812 (2014).
Vidal et al. "Making sense of antisense" European Journal of Cancer, 41:2812-2818 (2005).
Wei et al. "Indian Hedgehog and its targets in human endometrium: menstrual cycle expression and response to CDB-2914" The Journal of Clinical Endocrinology and Metabolism, 95:5330-5337 (2010).
Winkler, Johannes "Oligonucleotide conjugates for therapeutic applications" Therapeutic Delivery, 4(7):791-809 (2013).
Yoo et al. "CRISPLD2 Is a Target of Progesterone Receptor and Its Expression Is Decreased in Women with Endometriosis" PLoS One, 9(6):e100481 (2014).
Yoo et al. "KRAS Activation and over-expression of SIRT1/BCL6 Contributes to the Pathogenesis of Endometriosis and Progesterone Resistance" Scientific Reports, 7(6765):1-12 (2017).
Young et al. "B-Cell Lymphoma Protein 6 (BCL-6): A Novel Diagnostic Marker for Endometriosis" Fertility and Sterility, 102(3 Suppl 1):e11, abstract O-28 from the 70th Annual Meeting of the American Society for Reproductive Medicine, ASRM (2014).
Yu et al. "BCL6 negatively regulates macrophage proliferation by suppressing autocrine IL-6 production" Blood, 105:1777-1784 (2005).
Acris "Polyclonal Antibody to SIRT1 (577-590)—Aff—Purified" Catalog No. TA303141, data sheet (2 pages) (2016).
Asaka et al. "Sirtuin 1 promotes the growth and cisplatin resistance of endometrial carcinoma cells: a novel therapeutic target" Laboratory Investigation, pp. 1-11 (2015).
Bordone et al. "SIRT1 transgenic mice show phenotypes resembling calorie restriction" Aging Cell, 6:759-767 (2007).
Dinulescu et al. "Role of K-ras and Pten in the development of mouse models of endometriosis and endometrioid ovarian cancer" Nature Medicine, 11(1):63-70 (2005).
International Search Report and the Written Opinion of the International Searching Authority corresponding to International Patent Application No. PCT/US2017/025339 (11 pages) (dated Aug. 14, 2017).
Jang et al. "Expression and prognostic significance of SIRT1 in ovarian epithelial tumours" Pathology, 41(4):366-371 (2009).
Lin et al. "SIRT1 promotes endometrial tumor growth by targeting SREBP1 and lipogenesis" Oncology Reports, 32:2831-2835 (2014).
Tatone et al. "Sirtuin Functions in Female Fertility: Possible Role in Oxidative Stress and Aging" Oxidative Medicine and Cellular Longevity, Article ID 659687 (11 pages) (2015).

* cited by examiner

METHODS AND COMPOSITIONS FOR SIRT1 EXPRESSION AS A MARKER FOR ENDOMETRIOSIS AND SUBFERTILITY

PRIORITY STATEMENT

This application is a 35 U.S.C. § 371 national phase application of International Application Serial No. PCT/US2017/025339, filed Mar. 31, 2017, which claims the benefit, under 35 U.S.C. § 119(e), of U.S. Provisional Application Ser. No. 62/316,163, filed Mar. 31, 2016 and U.S. Provisional Application Ser. No. 62/471,915, filed Mar. 15, 2017, the entire contents of each of which are incorporated by reference herein.

STATEMENT REGARDING ELECTRONIC FILING OF A SEQUENCE LISTING

A Sequence Listing in ASCII text format, submitted under 37 C.F.R. § 1.821, entitled 5470-810 ST25.txt, 1,468,021 bytes in size, generated on Sep. 28, 2018 and filed via EFS-Web, is provided in lieu of a paper copy. This Sequence Listing is incorporated by reference into the specification for its disclosures.

STATEMENT OF GOVERNMENT SUPPORT

This invention was made with government support under Grant Numbers HD067721 and HD084478, awarded by the National Institutes of Health. The government has certain rights in the invention.

TECHNICAL FIELD

The presently disclosed subject matter pertains in some embodiments to methods and compositions for use in the detection and management of treatment of endometriosis and/or subfertility/infertility. Also provided are methods, compositions, and kits for use in the assessing the likelihood of successful implantation of in vitro fertilized ova and/or frozen embryos.

BACKGROUND

Endometriosis is a gynecologic disorder defined by the presence of endometrial cells outside of the uterine cavity (Sampson, 1927). Endometriosis is a major cause of infertility and pelvic pain. It affects about greater than 5% of reproductive-age women, more than half of whom are infertile (Strathy et al., 1982; Verkauf 1987; Bulun, 2009; de Ziegler et al., 2010), and adds upwards of $22 billion dollars per year in health care costs the United States alone (Asante & Taylor, 2011). Its symptoms vary widely, and include dysmenorrhea, dyspareunia, noncyclic chronic pelvic pain, and infertility, and it has a considerable negative impact on quality of life (Fourquet et al., 2011; Simoens et al., 2012).

Despite the lack of diagnostic tests, once diagnosis is made there are effective treatments. Surgical removal of ectopic lesions and/or hormonal suppression focused on reducing estrogen, such as progestins, androgens, gonadotropin-releasing hormone (GnRH) agonists, and aromatase inhibitors, are the current gold standards of therapy. However, both surgical and non-surgical approaches are associated with various side effects and a high incidence of relapse (Sinaii et al., 2002; Bulun, 2009). For example, surgical therapy for endometriosis can relieve pain, but given the lack of symptom specificity, physicians are reluctant to perform possibly unnecessary surgery, leading to delays in diagnosis and progression of the disease. An even greater problem is the uncertainty surrounding endometriosis and infertility. Only about half of women with endometriosis meet the diagnostic criteria for infertility and there is no test to know whether a patient's fertility will benefit from surgical therapy of endometriosis. Furthermore, many of the women with endometriosis-related infertility have no other symptoms. In fact, it has been calculated that the number of women with possible endometriosis who need to undergo surgery in order to help one conceive (number needed to treat (NNT)) is about 12. Furthermore, surgery can delay fertility treatments due at least in part to various limitations impose pre- and post-operatively.

Provided herein is a sensitive test for endometriosis and/or subfertility/infertility. Also provided are additional methods for managing treatment of subjects with endometriosis and subfertility/infertility. Such tests and methods avoid delays in diagnosis and ineffective treatment and/or reduce the need for invasive procedures. Further provided are methods for assessing the likelihood of successful implantation of in vitro fertilized ova and/or frozen embryos.

SUMMARY OF THE INVENTION

This summary lists several embodiments of the presently disclosed subject matter, and in many cases lists variations and permutations of these embodiments. This Summary is merely exemplary of the numerous and varied embodiments. Mention of one or more representative features of a given embodiment is likewise exemplary. Such an embodiment can typically exist with or without the feature(s) mentioned; likewise, those features can be applied to other embodiments of the presently disclosed subject matter, whether listed in this Summary or not. To avoid excessive repetition, this Summary does not list or suggest all possible combinations of such features.

In some embodiments, the presently disclosed subject matter provides methods for identifying subjects as candidates for implantation of embryos. In some embodiments, the methods comprise providing a sample of endometrium from a subject, wherein the sample comprises endometrium isolated from the subject during the second half of the subject's menstrual cycle; detecting a level of expression of a SIRT1 gene product in the sample, and optionally also detecting a level of expression of a BCL6 gene product in the sample; correlating the expression level of the SIRT1 gene product and optionally of the BCL6 gene product in the sample with endometrial receptivity, wherein overexpression of the SIRT1 gene product and optionally of the BCL6 gene product in the sample as compared to expression of the SIRT1 gene product and optionally of the BCL6 gene product in a sample of similarly timed endometrium isolated from a normally fertile control subject is indicative of reduced receptivity of the endometrium in the subject; and determining whether the subject is a candidate for implantation of an embryo based on the correlating step, wherein the determining step identifies the subject as a candidate for implantation of an embryo. In some embodiments, the sample is a biopsy sample, optionally a formalin fixed, paraffin embedded biopsy section thereof. In some embodiments, the detecting step comprises staining the sample with a first primary antibody that binds to the SIRT1 gene product, and optionally also with a second primary antibody that binds to the BCL6 gene product. In some embodiments, the first and second primary antibodies are detectably labeled or are themselves detectable optionally by contacting the first and second primary antibodies with one or more detectably labeled secondary antibodies that bind to the first primary antibody, the second primary antibody, or both. In some embodiments, the subject is a candidate for implantation of an embryo when an HSCORE calculated for the level of expression of the SIRT1 gene product, and optionally also the BCL6 gene product, in the sample is less than a pre-determined cut-off value. In some embodiments, the HSCORE is calculated using the following equation: HSCORE=$\Sigma$ Pi (i+1)/100, where i=the intensity of staining of cells in the sample with a value of 1 being low staining, 2 being moderate staining, and 3 being strong staining, and Pi being the percentage of stained cells in the sample for each intensity, varying from 0-100%. In some embodiments, the pre-determined cut-off value is selected from the group consisting of 1.0, 1.1, 1.2, 1.3, 1.4, 1.5, 1.6, 1.7, 1.8, 1.9, and 2.0.

In some embodiments, the presently disclosed subject matter also provides methods for identifying subjects as candidates for implantation of embryos. In some embodiments, the methods comprise providing a sample of endometrium from a subject, wherein the sample comprises endometrium isolated from the subject during the second half of the subject's menstrual cycle; detecting a level of expression of a SIRT1 gene product in the sample, and optionally also of a BCL6 gene product in the sample, an further optionally a level of expression of a beta3 integrin gene product in the sample; determining whether or not the endometrium of the subject is in phase or out of phase; correlating the expression level or expression levels detected and whether or not the endometrium of the subject is in phase or out of phase with receptivity of the endometrium of the subject; and determining whether the subject is a candidate for implantation of an embryo based on the correlating step, wherein the determining step identifies the subject as a candidate for implantation of an embryo. In some embodiments, the sample is a biopsy sample, optionally a formalin fixed, paraffin embedded biopsy section thereof. In some embodiments, the detecting step comprises staining the sample with a first primary antibody that binds to the SIRT1 gene product and optionally a second primary antibody that binds to the BCL6 gene product, and further optionally a third primary antibody that binds to the beta3 integrin gene product. In some embodiments, the first, the second, and the third primary antibodies are detectably labeled or are themselves detectable optionally by contacting the first primary antibody, the second primary antibody if employed, and the third primary antibody if employed with a first detectably labeled secondary antibody that binds to the first primary antibody, a second detectably labeled secondary antibody that binds to the second primary antibody if employed, and a third detectably labeled secondary antibody that binds to the third primary antibody if employed. In some embodiments, the subject is a candidate for implantation of an embryo if: (i) a first HSCORE value calculated for the level of expression of the SIRT1 gene product in the sample is less than a first pre-determined cut-off value, and optionally a second HSCORE value calculated for the level of expression of the BCL6 gene product in the sample is less than a second pre-determined cut-off value; or (ii) an HSCORE value calculated for the level of expression of the beta3 integrin gene product in the sample is greater than a third pre-determined cut-off value; or (iii) an HSCORE value calculated for the level of expression of the beta3 integrin gene product in the sample is less than a fourth pre-determined cut-off value and the endometrium of the subject is out of phase. In some embodiments, the HSCORE value(s) is/are calculated using the following equation: HSCORE=$\Sigma$ Pi (i+1)/100, where i=the intensity of staining of cells in the sample with a value of 1 being low staining, 2 being moderate staining, and 3 being strong staining, and Pi being the percentage of stained cells in the sample for each intensity, varying from 0-100%. In some embodiments, each pre-determined cut-off value is selected from the group consisting of 1.0, 1.1, 1.2, 1.3, 1.4, 1.5, 1.6, 1.7, 1.8, 1.9, and 2.0.

The presently disclosed subject matter also provides in some embodiments methods for identifying an increased risk for implantation failure subsequent to in vitro fertilization (IVF) and/or frozen embryo transfer (FET) in a subject. In some embodiments, the methods comprise determining a SIRT1 status, optionally a BCL6 status, further optionally a beta3 integrin status, and a endometrial phase status for a subject undergoing IVF and/or FET treatment, wherein an abnormal SIRT1 and/or BCL6 status in the subject and/or an abnormal beta3 status accompanied by in phase histological phase status is indicative of increased risk for implantation failure in the subject. In some embodiments, an abnormal SIRT1 and/or BCL6 status comprises a HSCORE value for the subject with respect to SIRT1 expression and/or BCL6 gene product expression during the second half of the subject's menstrual cycle that is greater than a pre-determined cut-off value. In some embodiments, each HSCORE value is calculated using the following equation: HSCORE=$\Sigma$ Pi (i+1), where i=the intensity of staining of cells in the sample with a value of 1 being low staining, 2 being moderate staining, and 3 being strong staining, and Pi being the percentage of stained cells in the sample for each intensity, varying from 0-100%. In some embodiments, the pre-determined cut-off value is selected from the group consisting of 1.0, 1.1, 1.2, 1.3, 1.4, 1.5, 1.6, 1.7, 1.8, 1.9, and 2.0. In some embodiments, an abnormal beta3 status comprises an HSCORE for the subject with respect to beta3 gene product expression during the second half of the subject's menstrual cycle that is greater than a pre-determined cut-off value.

In some embodiments, the presently disclosed subject matter also provides methods for detecting endometrial receptivity to embryo implantation in subjects, optionally subfertile subjects. In some embodiments, the methods comprise (a) obtaining a sample of endometrium from the subject, wherein the sample is isolated from the subject during the second half of the subject's menstrual cycle; (b) detecting an expression level of a SIRT1 gene product, and optionally an expression level of BCL6 gene product, in the sample; and (c) correlating the expression level of the SIRT1 gene product, and optionally also of the BCL6 gene product, in the sample with endometrial receptivity, wherein overexpression of the SIRT1 gene product and optionally also of the BCL6 gene product in the sample as compared to expression of the SIRT1 gene product and optionally also BCL6 gene product in a sample of endometrium isolated from a normally receptive control subject is indicative of reduced receptivity of the endometrium in the subject. In some embodiments, the sample is a tissue section and the detecting step comprises immunohistochemically staining the sample with a first primary antibody that binds to the SIRT1 gene product, and optionally with a second primary antibody that binds to the BCL6 gene product, and detecting binding of the first primary antibody to the SIRT1 gene product and optionally detecting binding of the second primary antibody to the BCL6 gene product. In some embodiments, the first and second primary antibodies comprise a first and a second detectable label, and detecting binding of the first primary antibody to the SIRT1 gene and optionally detecting binding of the second primary antibody to the BCL6 gene product detecting the first and optionally the second detectable labels. In some embodiments, detecting binding of the primary antibody to the BCL6 gene product comprises detecting a complex of the primary antibody and the BCL6 gene product using a labeled secondary antibody that is specific for the primary antibody. In some embodiments, the sample is a cell extract and the contacting and detecting steps comprise (a) immunoblotting with a first primary antibody comprising a first detectable label that is specific for the SIRT1 gene product and detecting the first detectable label, and optionally immunoblotting with a second primary antibody comprising a second detectable label that is specific for the BCL6 gene product and detecting the second detectable label; or (b) immunoblotting with a first primary antibody that is specific for the SIRT1 gene product and detecting the first primary antibody indirectly with a labeled first secondary antibody that binds to the first primary antibody, and optionally immunoblotting with a second primary antibody that is specific for the BCL6 gene product and detecting the second primary antibody indirectly with a labeled second secondary antibody that binds to the second primary antibody. In some embodiments, the embryo is produced by in vitro fertilization (IVF) or the embryo implantation comprises frozen embryo transfer (FET).

The presently disclosed subject matter also provides in some embodiments methods for facilitating diagnoses of infertility in mammals. In some embodiments, the methods comprise obtaining a sample of endometrium from the mammal, wherein the sample is isolated from the mammal during the second half of the mammal's menstrual cycle; detecting expression of SIRT1 and optionally also BCL6 in the sample; and correlating overexpression of SIRT1 and optionally also BCL6 in the sample with infertility. In some embodiments, the sample is a tissue section and the detecting step comprises immunohistochemically staining the sample with a first primary antibody that binds to a SIRT1 gene product and detecting binding of the first primary antibody to the SIRT1 gene product, and optionally immunohistochemically staining the sample with a second primary antibody that binds to a BCL6 gene product and detecting binding of the second primary antibody to the BCL6 gene product. In some embodiments, the first primary antibody comprises a first detectable label and detecting binding of the first primary antibody to the SIRT1 gene product comprises detecting the first detectable label, and optionally further wherein the second primary antibody comprises a second detectable label and detecting binding of the second primary antibody to the BCL6 gene product comprises detecting the second detectable label. In some embodiments, detecting binding of the first primary antibody to the SIRT1 gene product comprises detecting a complex of the first primary antibody and the SIRT1 gene product using a first labeled secondary antibody that is specific for the first primary antibody, and optionally further wherein detecting binding of the second primary antibody to the BCL6 gene product comprises detecting a complex of the second primary antibody and the BCL6 gene product using a second labeled secondary antibody that is specific for the second primary antibody. In some embodiments, the sample is a cell extract and the contacting and detecting steps comprise (a) immunoblotting with a first primary antibody comprising a first detectable label that is specific for the SIRT1 gene product and detecting the first detectable label, and optionally immunoblotting with a second primary antibody comprising a second detectable label that is specific for the BCL6 gene product and detecting the second detectable label; or (b) immunoblotting with a first primary antibody that is specific for the SIRT1 gene product and detecting the first primary antibody indirectly with a first labeled secondary antibody that binds to the first primary antibody, and optionally immunoblotting with a second primary antibody that is specific for the BCL6 gene product and detecting the second primary antibody indirectly with a second labeled secondary antibody that binds to the second primary antibody.

The presently disclosed subject matter also provides in some embodiments methods for increasing the likelihood of implantation of embryos in subjects with decreased endometrial receptivity due to overexpression of SIRT1 gene products during the subjects' menstrual cycles and optionally also BCL6 gene products during the second half of the subjects' menstrual cycles. In some embodiments, the methods comprise providing a subject with decreased endometrial receptivity due to increased SIRT1 expression and optionally also increased BCL6 expression; and administering to the subject an effective amount of a SIRT1 inhibitor and optionally also a BCL6 inhibitor.

The presently disclosed subject matter also provides in some embodiments methods of detecting the presence of endometriosis in subjects. In some embodiments, the methods comprise providing a sample of endometrium from a subject, wherein the sample comprises endometrium isolated from the subject; detecting a level of expression of a SIRT1 gene product and optionally also of a BCL6 gene product in the sample; and correlating the expression level(s) of the SIRT1 gene product and optionally of the BCL6 gene product in the sample with the presence of endometriosis in the subject, wherein overexpression of the SIRT1 gene product and optionally also of the BCL6 gene product in the sample as compared to expression of the SIRT1 gene product and optionally also of the BCL6 gene product in a sample of similarly timed endometrium isolated from a normal control subject is indicative of the presence of endometriosis in the subject. In some embodiments, the sample is a biopsy sample, optionally a formalin fixed, paraffin embedded biopsy section thereof. In some embodiments, the detecting step comprises staining the sample with a first primary antibody that binds to the SIRT1 gene product, and optionally further comprises staining the sample with a second primary antibody that binds to the BCL6 gene product. In some embodiments, the first and optionally the second primary antibodies are detectably labeled or are themselves detectable optionally by contacting the first and second primary antibodies with one or more detectably labeled secondary antibodies that bind to the first primary antibody or the second primary antibody. In some embodiments, the presence of endometriosis in the subject is indicated when an HSCORE calculated for the level of expression of the SIRT1 gene product in the sample is less than a first pre-determined cut-off value, and optionally when an HSCORE calculated for the level of expression of the BCL6 gene product in the sample is less than a second pre-determined cut-off value. In some embodiments, the HSCORE(s) is/are calculated using the following equation: HSCORE=$\Sigma$ Pi (i+1)/100, where i=the intensity of staining of cells in the sample with a value of 1 being low staining, 2 being moderate staining, and 3 being strong staining, and Pi being the percentage of stained cells in the sample for each intensity, varying from 0-100%. In some embodiments, the first and/or the second pre-determined cut-off value(s)

is/are selected from the group consisting of 1.0, 1.1, 1.2, 1.3, 1.4, 1.5, 1.6, 1.7, 1.8, 1.9, and 2.0.

The presently disclosed subject matter also provides in some embodiments methods for managing treatment of subjects with potential endometriosis, subfertility, recurrent pregnancy loss, progesterone-resistance, or any combination thereof. In some embodiments, the methods comprise providing a subject suspected of having endometriosis, subfertility, recurrent pregnancy loss, progesterone-resistance, or any combination thereof; detecting the presence or absence of biomarker SIRT1 in a sample from the subject, and optionally detecting the presence or absence of biomarker BCL6 in the sample from the subject, and further optionally detecting the presence or absence of biomarker beta 3 in the sample from the subject; and managing the treatment of the subject based on the detecting step. In some embodiments, the presence of SIRT1 or SIRT1 and BCL6 suggests the presence of endometriosis. In some embodiments, the managing of the treatment of subject comprises assigning the subject for surgery to treat the endometriosis.

With respect to the methods disclosed herein, the presence of SIRT1 or SIRT1 and BCL6 in combination with an absence of beta3 suggests the presence of endometriosis-related subfertility due to endometrial dysfunction. In some embodiments, the managing of the treatment of the subject comprises assigning the subject for surgery to treat the subfertility.

In some embodiments of the presently disclosed methods, the absence of SIRT1 or the absence of both SIRT1 and BCL6, optionally in combination with absence of beta3, suggests subfertility due to endometrial dysfunction. In some embodiments, the managing of the treatment of the subject comprises assessing histomorphology of the sample for midsecretory phase and assigning the subject for a treatment other than surgery to treat endometriosis-related subfertility.

In some embodiments of the presently disclosed methods, the absence of SIRT1, or the absence of both SIRT1 and BCL6, optionally in combination with absence of beta3, is observed and the managing of the treatment of the subject comprises assessing histomorphology of the sample for early secretory phase or proliferative phase.

In some embodiments of the presently disclosed methods, the sample is a uterine tissue sample.

The presently disclosed subject matter also provides in some embodiments methods for detecting the presence of endometriosis, subfertility, recurrent pregnancy loss, progesterone-resistance, or any combination thereof in subjects. In some embodiments, the methods comprise providing a subject suspected of having endometriosis, subfertility, recurrent pregnancy loss, progesterone-resistance, or any combination thereof; detecting the presence or absence of biomarker SIRT1, optionally SIRT1 and BCL6, further optionally SIRT1, BCL6, and beta3, in a sample from the subject; and determining the presence endometriosis, subfertility, recurrent pregnancy loss, progesterone-resistance, or any combination thereof in the subject based on the detecting step. In some embodiments, the sample comprises a uterine tissue sample.

In some embodiments of the presently disclosed methods, the sample comprises fluids and/or washings of the uterine lining, a cervical lavage, a brushing, and/or blood.

The presently disclosed subject matter also provides in some embodiments methods for treating subject with endometriosis, subfertility, infertility, recurrent pregnancy loss, progesterone-resistance, or any combination thereof associated with overexpression of endometrial SIRT1 during the menstrual cycle or SIRT1 during the menstrual cycle and BCL6 during the secretory phase of the menstrual cycle. In some embodiments, the methods comprise providing a subject with endometriosis, subfertility, recurrent pregnancy loss, progesterone-resistance, or any combination thereof associated with overexpression of endometrial SIRT1 during the menstrual cycle or SIRT1 during the menstrual cycle and endometrial BCL6 during the secretory phase of the menstrual cycle; administering to the subject a first treatment that inhibits SIRT1 in the subject's endometriosis and optionally a second treatment that inhibits BCL6 in the subject's endometriosis; and assaying endometrial SIRT1 gene expression during the menstrual cycle, optionally in combination with BCL6 gene expression during the secretory phase of the menstrual cycle, of the subject to determine if endometrial SIRT1 and optionally BCL6 gene expression in the subject has been reduced to below a pre-determined level, wherein the administering and assaying steps are optionally repeated until endometrial SIRT1 gene expression during the menstrual cycle, optionally in combination with BCL6 gene expression during the secretory phase of the menstrual cycle, is reduced to below a pre-determined level at any time during the menstrual cycle for SIRT1 or during the secretory phase of the subject's menstrual cycle for BCL6. In some embodiments, the treatment that reduces or eliminates the subject's endometriosis comprises surgical removal of some or all of the endometriosis, treatment of the subject with a gonadotropin-releasing hormone (GnRH) agonist, treatment of the subject with an inhibitor of an SIRT1 biological activity, or any combination thereof. In some embodiments, the assaying comprises contacting an endometrial biopsy sample isolated from the subject during the subject's menstrual cycle with an antibody that binds to SIRT1 to create an SIRT1/antibody complex, and optionally also contacting an endometrial biopsy sample isolated from the subject during the secretory phase of the subject's menstrual cycle with an antibody that binds to BCL6 to create a BCL6/antibody complex; and detecting the amount of the SIRT1/antibody complex and optionally the BCL6/antibody complex formed. In some embodiments, the first treatment that inhibits SIRT1 comprises administering to the subject an miRNA that targets SIRT1, optionally wherein the miRNA is an miRNA34 family member, optionally miRNA34a.

In some embodiments, the presently disclosed subject matter also provides methods for modulating SIRT1 biological activity and optionally also BCL6 biological activity in subjects. In some embodiments, the methods comprise administering to a subject a therapeutically effective amount of an inhibitor of STAT3 biological activity. In some embodiments, the inhibitor of STAT3 biological activity is selected from the group consisting of an anti-STAT3 antibody or a paratope-containing fragment or derivative thereof, an SH2 domain inhibitor or dimerization inhibitor (SDI, site B), a DNA binding domain inhibitor (DBDI, site C); an N-terminal domain inhibitor (NDI, site D), or any combination thereof.

In some embodiments of the presently disclosed methods, the subject is a human.

Accordingly, it is an object of the presently disclosed subject matter to provide methods for detecting endometriosis and/or subfertility, and/or for assessing the likelihood of successful implantation of in vitro fertilized ova and/or frozen embryos. This and other objects are achieved in whole or in part by the presently disclosed subject matter.

An object of the presently disclosed subject matter having been stated above, other objects and advantages will become apparent upon a review of the following description and figures.

BRIEF DESCRIPTION OF THE DRAWINGS

FIG. 1A is a graph of the results of quantification of SIRT1 protein levels by western blot analysis in eutopic endometrium from proliferative and secretory phase in women with (Endo) and without (Ctrl) endometriosis obtained by densitometric analysis. FIG. 1B depicts representative results of western blot analyses of SIRT1 expression in endometrium from women with (Endometriosis) and without (Control) endometriosis in the proliferative (Prol) and secretory (Sec) phases. Actin is shown as a loading control. FIG. 1C is a plot of H-scores of SIRT1 expression in endometrium from women with (Endometriosis) and without (Control) endometriosis. The results represent the mean±SEM.  $p<0.01$ and* $p<0.001$.

FIG. 2A is a series of western blot analyses of E-cadherin, Vimentin, SIRT1, and BCL6 proteins in proliferative and early, mid, and late secretory phase of human endometrium with endometriosis. β-actin was used as sample-loading control. FIG. 2B is a graph showing a correlation between SIRT1 and BCL6 expression in women with endometriosis throughout the menstrual cycle phases based on western blot analyses (correlation coefficient=0.4641; $p=0.0009$).

FIG. 3 shows a plot of H-scores of GLI1 expression in endometrium from women with and without endometriosis. The results represent the mean±SEM. * $p<0.05$.

BRIEF DESCRIPTION OF THE SEQUENCE LISTING

Figure 1:
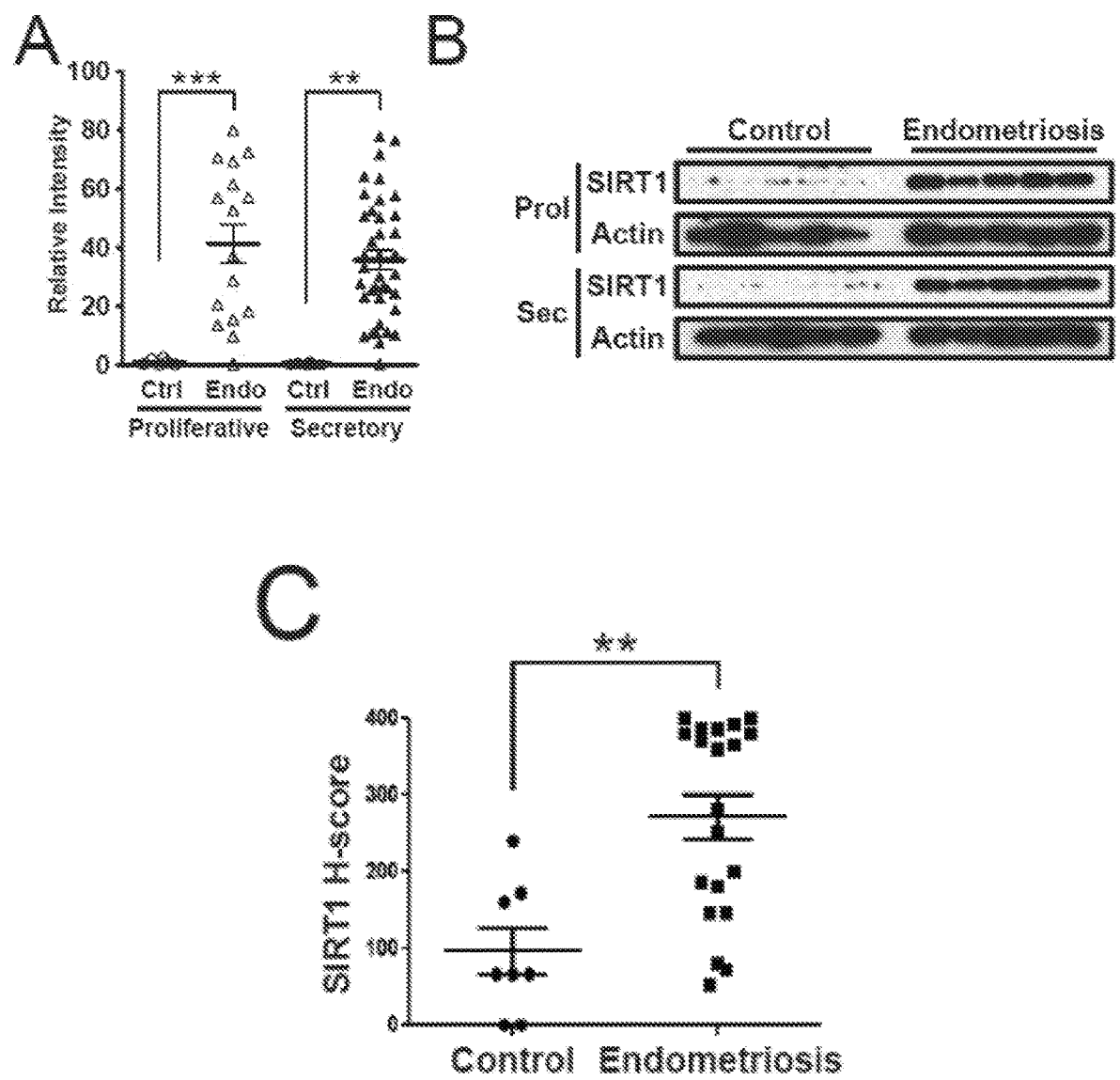
FIGS. 1A-1C show the results of experiments investigating the expression levels of SIRT1 in endometrium from women with and without endometriosis.

SEQ ID NOs: 1-72 are exemplary nucleotide and amino acid sequences of BCL6 gene products from various species.

SEQ ID NOs: 73-116 are exemplary nucleotide and amino acid sequences of beta3 gene products from various species.

SEQ ID NOs: 117-152 are exemplary nucleotide and amino acid sequences of SIRT1 gene products from various species.

SEQ ID NOs: 153 and 154 are the nucleotide sequences of forward and reverse oligonucleotide primers, respectively employed in ChIP analysis of BCL6 A. SEQ ID NO: 153 corresponds to nucleotides 57,459,829 to 57,459,847 of Accession No. NC_000012.12 of the GENBANK® biosequence database, and SEQ ID NO: 154 corresponds to the reverse-complement of nucleotides 57,459,913 to 57,459,932 of Accession No. NC_000012.12 of the GENBANK® biosequence database.

SEQ ID NOs: 155 and 156 are the nucleotide sequences of forward and reverse oligonucleotide primers, respectively employed in ChIP analysis of BCL6 B. SEQ ID NO: 155 corresponds to nucleotides 57,458,875 to 57,458,894 of Accession No. NC_000012.12 of the GENBANK® biosequence database, and SEQ ID NO: 156 corresponds to the reverse-complement of nucleotides 57,458,973 to 57,458,992 of Accession No. NC_000012.12 of the GENBANK® biosequence database.

Accession No. NC_000012.12 of the GENBANK® biosequence database corresponds to the nucleotide sequence of human chromosome 12, and the human GLI1 locus maps to this region of human chromosome 12. SEQ ID NOs: 153-165 are present upstream of (i.e., 5' to) the transcriptional start site of the human GLI1 gene on chromosome 12.

SEQ ID NOs: 157 and 158 are the nucleotide sequences of forward and reverse oligonucleotide primers, respectively, employed in ChIP analysis as negative controls.

SEQ ID NO: 159 is the amino acid sequence of an exemplary BCL6 Peptide Inhibitor known as BPI-1. In this sequence, amino acids 2-10, 13-20, 23-25, 27, 28, 30-33, 35-37, 39, and 40 are D-isomer forms of the respective amino acids.

SEQ ID NOs: 160 and 161 are the sequences of exemplary peptide inhibitors of BCL6.

SEQ ID NO:164 is the amino acid sequence of human sirtuin-1 (GenBank® Database Accession No. Q96EB6). Residues 577-590 (EKPQEVQTSRNVES) (bolded in the sequence below) are included in the epitope that is bound by the anti-Sirt1 monoclonal antibody described herein.

disclosed subject matter can, however, be embodied in different forms and should not be construed as limited to the embodiments set forth herein. Rather, these embodiments are provided so that this disclosure will be thorough and complete, and will fully convey the scope of the presently disclosed subject matter to those skilled in the art.

In some embodiments, the present invention provides a method of diagnosing and optionally, treating infertility in a subject, comprising: a) obtaining a sample from the subject; b) detecting a level of expression of a SIRT1 gene and/or protein in the sample; c) detecting a level of expression of a BCL6 gene and/or protein in the sample; d) comparing the level of expression detected in (b) with the level of expression of a SIRT1 gene and/or protein in a sample obtained from a control subject or a population of control subjects; e) comparing the level of expression detected in (c) with the level of expression of a BCL6 gene and/or protein in a sample obtained from a control subject or a population of control subjects; f) diagnosing the subject as having infertility when the subject has a level of expression of the SIRT1 gene and/or protein greater than the level of expression of the SIRT1 gene and/or protein of the control subject or population of control subjects and also has a level of expression of the BCL6 gene and/or protein that is greater than the level of expression of the BCL6 gene and/or protein of the control subject or population of control subjects; and optionally, g) administering to the subject an effective amount of a BCL6 inhibitor and/or a treatment that blocks or reduces BCL6 activity and/or an effective amount of a SIRT1 inhibitor and/or a treatment that blocks or reduces SIRT1 activity, singly or in any combination.

The present invention also provides a method of diagnosing and optionally treating infertility in a subject, comprising: a) obtaining a sample from the subject; b) detecting a level of expression of a SIRT1 gene and/or protein in the sample; c) calculating an HSCORE for the subject based on the level of expression of the SIRT1 protein detected in (b);

```
  1  madeaalalq  pggspsaaga  dreaasspag  eplrkrprrd  gpglerspge  pggaaperev 61  paaargcpga  aaaalwreae  aeaaaaggeq  eaqataaage  gdngpglqgp  sreppladnl 121  ydeddddege  eeeeaaaaai  gyrdnllfgd  eiitngfhsc  esdeedrash  asssdwtprp 181  rigpytfvqq  hlmigtdprt  ilkdllpeti  pppelddmtl  wqivinilse  ppkrkkrkdi 241  ntiedavkll  qeckkiivlt  gagvsvscgi  pdfrsrdgiy  arlavdfpdl  pdpqamfdie 301  yfrkdprpff  kfakeiypgq  fqpslchkfi  alsdkegkll  rnytqnidtl  eqvagiqrii 361  qchgsfatas  clickykvdc  eavrgdifnq  vvprcprcpa  deplaimkpe  ivffgenlpe 421  qfhramkydk  devdllivig  sslkvrpval  ipssiphevp  qilinreplp  hlhfdvellg 481  dcdviinelc  hrlggeyakl  ccnpvklsei  tekpprtqke  laylselppt  plhvsedsss 541  pertsppdss  vivtlldqaa  ksnddldvse  skqcmeekpq  evqtsrnves  iaeqmenpdl 601  knvgsstgek  nertsvagtv  rkcwpnrvak  eqisrrldgn  qylflppnry  ifhgaevysd 661  seddvlssss  cgsnsdsgtc  qspsleepme  deseieefyn  gledepdvpe  raggagfgtd 721  gddqeainea  isvkqevtdm  nypsnks
```

DETAILED DESCRIPTION OF THE INVENTION

The present subject matter will be now be described more fully hereinafter with reference to the accompanying EXAMPLES, in which representative embodiments of the presently disclosed subject matter are shown. The presently d) detecting a level of expression of a BCL6 gene and/or protein in the sample; e) calculating an HSCORE for the subject based on the level of expression of the BCL6 protein detected in (d); f) diagnosing the subject as having infertility when the subject has an HSCORE calculated for a level of expression of a SIRT1 protein that is greater than a predetermined cut-off value, and an HSCORE calculated for a level of expression of a BCL6 protein that is greater than a pre-determined cut-off value; and g) optionally administering to the subject an effective amount of a BCL6 inhibitor and/or a treatment that blocks or reduces BCL6 activity and/or an effective amount of a SIRT1 inhibitor and/or a treatment that blocks or reduces SIRT1 activity, singly or in any combination.

The present invention also provides a method for increasing the likelihood of implantation of an embryo in a subject with decreased endometrial receptivity due to overexpression of a SIRT1 gene and/or protein and a BCL6 gene and/or protein, comprising administering to the subject having overexpression of a SIRT1 gene and/or protein and a BCL6 gene and/or protein an effective amount of a BCL6 inhibitor and/or a treatment that blocks or reduces BCL6 activity and/or an effective amount of a SIRT1 inhibitor and/or a treatment that blocks or reduces SIRT1 activity, singly or in any combination.

The present invention also provides a method of treating infertility in a subject in need thereof, comprising administering to a subject having overexpression of a SIRT1 gene and/or protein and a BCL6 gene and/or protein an effective amount of a BCL6 inhibitor and/or a treatment that blocks or reduces BCL6 activity and/or an effective amount of a SIRT1 inhibitor and/or a treatment that blocks or reduces SIRT1 activity, singly or in any combination.

The present invention additionally provides a method of treating endometriosis in a subject in need thereof, comprising administering to a subject having overexpression of a SIRT1 gene and/or protein and a BCL6 gene and/or protein an effective amount of a BCL6 inhibitor and/or a treatment that blocks or reduces BCL6 activity and/or an effective amount of a SIRT1 inhibitor and/or a treatment that blocks or reduces SIRT1 activity and/or by surgically removing some or all of the endometriosis and/or administration to the subject an effective amount of a gonadotropin-releasing hormone (GnRH) agonist, singly or in any combination.

The present invention further provides a method of diagnosing and treating endometriosis in a subject, comprising: a) obtaining a sample from the subject; b) detecting a level of expression of a SIRT1 gene and/or protein in the sample; c) detecting a level of expression of a BCL6 gene and/or protein in the sample; d) comparing the level of expression detected in (b) with the level of expression of a SIRT1 gene and/or protein in a sample obtained from a control subject or a population of control subjects; e) comparing the level of expression detected in (c) with the level of expression of a BCL6 gene and/or protein in a sample obtained from a control subject or a population of control subjects; f) diagnosing the subject as having endometriosis when the subject has a level of expression of the SIRT1 gene and/or protein greater than the level of expression of the SIRT1 gene and/or protein of the control subject or population of control subjects, and has a level of expression of the BCL6 gene and/or protein that is greater than the level of expression of the BCL6 gene and/or protein of the control subject or population of control subjects; and g) treating the endometriosis in the subject by administering to the subject an effective amount of a BCL6 inhibitor and/or a treatment that blocks or reduces BCL6 activity and/or an effective amount of a SIRT1 inhibitor and/or a treatment that blocks or reduces SIRT1 activity and/or by surgical removal of some or all of the endometriosis and/or administration to the subject of an effective amount of a gonadotropin-releasing hormone (GnRH) agonist, singly or in any combination.

Also provided herein is a method of diagnosing and treating endometriosis in a subject, comprising: a) obtaining a sample from the subject; b) detecting a level of expression of a SIRT1 gene and/or protein in the sample; c) calculating an HSCORE for the subject based on the level of expression detected in (b); d) detecting a level of expression of a BCL6 gene and/or protein in the sample; e) calculating an HSCORE for the subject based on the level of expression detected in (d); f) diagnosing the subject as having endometriosis when the subject has an HSCORE calculated for a level of expression of a SIRT1 protein that is greater than a pre-determined cut-off value, and an HSCORE calculated for the level of expression of a BCL6 protein that is greater than a pre-determined cut-off value; and g) treating the endometriosis in the subject by administering to the subject an effective amount of a BCL6 inhibitor and/or a treatment that blocks or reduces BCL6 activity and/or an effective amount of a SIRT1 inhibitor and/or a treatment that blocks or reduces SIRT1 activity and/or by surgical removal of some or all of the endometriosis and/or administration to the subject of an effective amount of a gonadotropin-releasing hormone (GnRH) agonist, singly or in any combination.

The present invention also provides a method of managing treatment of endometriosis and/or infertility in a subject, comprising: a) obtaining a first sample from the subject; b) detecting a level of expression of a SIRT1 gene and/or protein in the sample; c) detecting a level of expression of a BCL6 gene and/or protein in the sample; d) comparing the level of expression detected in (b) with the level of expression of a SIRT1 gene and/or protein in a sample obtained from a control subject or a population of control subjects; e) comparing the level of expression detected in (c) with the level of expression of a BCL6 gene and/or protein in a sample obtained from a control subject or a population of control subjects; f) diagnosing the subject as having endometriosis and/or infertility when the subject has a level of expression of the SIRT1 gene and/or protein greater than the level of expression of the SIRT1 gene and/or protein of the control subject or population of control subjects, and a level of expression of the BCL6 gene and/or protein greater than the level of expression of the BCL6 gene and/or protein of the control subject or population of control subjects; g) treating the endometriosis and/or infertility; h) obtaining a subsequent sample from the subject at one or more time points following step (g); i) detecting a level of expression of a SIRT1 gene and/or protein in the subsequent sample; j) detecting a level of expression of a BCL6 gene and/or protein in the subsequent sample; and k) comparing the level of expression of the SIRT1 gene and/or protein detected in (b) with the level of expression of the SIRT1 gene and/or protein detected in (i) and comparing the level of expression of the BCL6 gene and/or protein detected in (c) with the level of expression of the BCL6 gene and/or protein detected in (j), wherein a decrease in (i) relative to (b) and a decrease in (j) relative to (c) in a subject indicates that the treatment can be halted or reduced, and an increase or no change in (i) relative to (b) and an increase or no change in (j) relative to (c) indicates that the treatment can be continued or increased.

The present invention additionally provides a method for managing treatment of endometriosis and/or infertility in a subject, comprising: a) obtaining a first sample from the subject; b) detecting a level of expression of a SIRT1 gene and/or protein in the first sample; c) calculating an HSCORE for the subject based on the level of expression of the SIRT1 protein in the first sample; d) detecting a level of expression of a BCL6 gene and/or protein in the first sample; e) calculating an HSCORE for the subject based on the level of expression of the BCL6 protein in the first sample; f)

diagnosing the subject as having endometriosis and/or infertility when the subject has an HSCORE based on the level of expression of the SIRT1 protein that is greater than a pre-determined cut-off value and an HSCORE based on the level of expression of the BCL6 protein that is greater than a pre-determined cut-off level; g) treating the endometriosis and/or infertility in the subject; h) obtaining a subsequent sample from the subject at one or more time points following step (g); i) detecting a level of expression of a SIRT1 gene and/or protein in the subsequent sample; j) calculating an HSCORE for the subject based on the level of expression of the SIRT1 protein in the subsequent sample; k) detecting a level of expression of a BCL6 gene and/or protein in the subsequent sample; l) calculating an HSCORE for the subject based on the level of expression of the BCL6 protein in the subsequent sample; and m) comparing the HSCORE of (c) with the HSCORE of (j) and comparing the HSCORE of (e) with the HSCORE of (l), wherein a decrease in the HSCORE of (j) relative to the HSCORE of (c), along with a decrease in the HSCORE of (l) relative to the HSCORE of (e) indicates that the treatment of the endometriosis and/or infertility can be halted or reduced, and no change or an increase in the HSCORE of (j) relative to the HSCORE of (c) to a value greater than or equal to a pre-determined cut-off value, along with either no change or an increase in the HSCORE of (l) relative to the HSCORE of (e) indicates that treatment of the endometriosis and/or infertility can be continued or increased.

The present invention further provides a method for identifying an increased risk for implantation failure associated with in vitro fertilization (IVF) and/or frozen embryo transfer (FET) in a subject, comprising: a) obtaining a sample from the subject; b) detecting a level of expression of a SIRT1 gene and/or protein in the sample, optionally by contacting the sample with a monoclonal antibody that specifically binds an epitope within amino acids 577-590 (EKPQEVQTSRNVES) of the human SIRT1 protein having the amino acid sequence of SEQ ID NO:164; c) detecting a level of expression of a BCL6 gene and/or protein in the sample; d) comparing the level of expression detected in (b) with the level of expression of a SIRT1 gene and/or protein in a sample obtained from a control subject or a population of control subjects; e) comparing the level of expression detected in (c) with the level of expression of a BCL6 gene and/or protein in a sample obtained from a control subject or a population of control subjects; f) identifying the subject as having an increased risk of implantation failure associated with in vitro fertilization (IVF) and/or frozen embryo transfer (FET) when the subject has a level of expression of the SIRT1 gene and/or protein greater than the level of expression of the SIRT1 gene and/or protein of the control subject or population of control subjects, and has a level of expression of the BCL6 gene and/or protein that is greater than the level of expression of the BCL6 gene and/or protein of the control subject or population of control subjects.

Further provided herein is a method for identifying an increased risk for implantation failure associated with in vitro fertilization (IVF) and/or frozen embryo transfer (FET) in a subject, comprising: a) obtaining a sample from the subject; b) detecting a level of expression of a SIRT1 gene and/or protein in the sample, optionally by contacting the sample with a monoclonal antibody that specifically binds an epitope within amino acids 577-590 of the human SIRT1 protein having the amino acid sequence of SEQ ID NO:164; c) calculating an HSCORE for the subject based on the level of expression detected in (b); d) detecting a level of expression of a BCL6 gene and/or protein in the sample; e) calculating an HSCORE for the subject based on the level of expression detected in (d); and f) identifying the subject as having an increased risk of implantation failure associated with in vitro fertilization (IVF) and/or frozen embryo transfer (FET) when the subject has an HSCORE calculated for a level of expression of a SIRT1 protein that is greater than a pre-determined cut-off value, and an HSCORE calculated for the level of expression of a BCL6 protein that is greater than a pre-determined cut-off value.

The present invention also provides a method of diagnosing and treating infertility in a subject, comprising: a) obtaining a sample from the subject; b) detecting a level of expression of a SIRT1 gene and/or protein in the sample; c) detecting a level of expression of a K-ras gene and/or protein in the sample; d) comparing the level of expression detected in (b) with the level of expression of a SIRT1 gene and/or protein in a sample obtained from a control subject or a population of control subjects; e) comparing the level of expression detected in (c) with the level of expression of a K-ras gene and/or protein in a sample obtained from a control subject or a population of control subjects; f) diagnosing the subject as having infertility when the subject has a level of expression of the SIRT1 gene and/or protein greater than the level of expression of the SIRT1 gene and/or protein of the control subject or population of control subjects and also has a level of expression of the K-ras gene and/or protein that is greater than the level of expression of the K-ras gene and/or protein of the control subject or population of control subjects; and g) administering to the subject an effective amount of a K-ras inhibitor and/or a treatment that blocks or reduces K-ras activity and/or an effective amount of a SIRT1 inhibitor and/or a treatment that blocks or reduces SIRT1 activity, singly or in any combination.

Also included herein is a method of diagnosing and treating infertility in a subject, comprising: a) obtaining a sample from the subject; b) detecting a level of expression of a SIRT1 gene and/or protein in the sample; c) calculating an HSCORE for the subject based on the level of expression of the SIRT1 protein detected in (b); d) detecting a level of expression of a K-ras gene and/or protein in the sample; e) calculating an HSCORE for the subject based on the level of expression of the K-ras protein detected in (d); f) diagnosing the subject as having infertility when the subject has an HSCORE calculated for a level of expression of a SIRT1 protein that is greater than a pre-determined cut-off value, and an HSCORE calculated for a level of expression of a K-ras protein that is greater than a pre-determined cut-off value; and g) administering to the subject an effective amount of a K-ras inhibitor and/or a treatment that blocks or reduces K-ras activity and/or an effective amount of a SIRT1 inhibitor and/or a treatment that blocks or reduces SIRT1 activity, singly or in any combination.

Further provided herein is a method for increasing the likelihood of implantation of an embryo in a subject with decreased endometrial receptivity due to overexpression of a SIRT1 gene and/or protein and a K-ras gene and/or protein, comprising administering to the subject having overexpression of a SIRT1 gene and/or protein and a K-ras gene and/or protein an effective amount of a K-ras inhibitor and/or a treatment that blocks or reduces K-ras activity and/or an effective amount of a SIRT1 inhibitor and/or a treatment that blocks or reduces SIRT1 activity, singly or in any combination.

A method is also provided herein of treating infertility in a subject in need thereof, comprising administering to a subject having overexpression of a SIRT1 gene and/or protein and a K-ras gene and/or protein an effective amount of a K-ras inhibitor and/or a treatment that blocks or reduces K-ras activity and/or an effective amount of a SIRT1 inhibitor and/or a treatment that blocks or reduces SIRT1 activity, singly or in any combination.

Furthermore, a method is provided herein of treating endometriosis in a subject in need thereof, comprising administering to a subject having overexpression of a SIRT1 gene and/or protein and a K-ras gene and/or protein an effective amount of a K-ras inhibitor and/or a treatment that blocks or reduces K-ras activity and/or an effective amount of a SIRT1 inhibitor and/or a treatment that blocks or reduces SIRT1 activity and/or by surgical removal of some or all of the endometriosis and/or administration to the subject of an effective amount of a gonadotropin-releasing hormone (GnRH) agonist, singly or in any combination.

The present invention additionally provides a method of diagnosing and treating endometriosis in a subject, comprising: a) obtaining a sample from the subject; b) detecting a level of expression of a SIRT1 gene and/or protein in the sample; c) detecting a level of expression of a K-ras gene and/or protein in the sample; d) comparing the level of expression detected in (b) with the level of expression of a SIRT1 gene and/or protein in a sample obtained from a control subject or a population of control subjects; e) comparing the level of expression detected in (c) with the level of expression of a K-ras gene and/or protein in a sample obtained from a control subject or a population of control subjects; f) diagnosing the subject as having endometriosis when the subject has a level of expression of the SIRT1 gene and/or protein greater than the level of expression of the SIRT1 gene and/or protein of the control subject or population of control subjects, and has a level of expression of the K-ras gene and/or protein that is greater than the level of expression of the K-ras gene and/or protein of the control subject or population of control subjects; and g) treating the endometriosis in the subject by administering to the subject an effective amount of a K-ras inhibitor and/or a treatment that blocks or reduces K-ras activity and/or an effective amount of a SIRT1 inhibitor and/or a treatment that blocks or reduces SIRT1 activity and/or by surgical removal of some or all of the endometriosis and/or administration to the subject of an effective amount of a gonadotropin-releasing hormone (GnRH) agonist, singly or in any combination.

The present invention also provides a method of diagnosing and treating endometriosis in a subject, comprising: a) obtaining a sample from the subject; b) detecting a level of expression of a SIRT1 gene and/or protein in the sample; c) calculating an HSCORE for the subject based on the level of expression detected in (b); d) detecting a level of expression of a K-ras gene and/or protein in the sample; e) calculating an HSCORE for the subject based on the level of expression detected in (d); f) diagnosing the subject as having endometriosis when the subject has an HSCORE calculated for a level of expression of a SIRT1 protein that is greater than a pre-determined cut-off value, and an HSCORE calculated for the level of expression of a K-ras protein that is greater than a pre-determined cut-off value; and g) treating the endometriosis in the subject by administering to the subject an effective amount of a K-ras inhibitor and/or a treatment that blocks or reduces K-ras activity and/or an effective amount of a SIRT1 inhibitor and/or a treatment that blocks or reduces SIRT1 activity and/or by surgical removal of some or all of the endometriosis and/or administration to the subject of an effective amount of a gonadotropin-releasing hormone (GnRH) agonist, singly or in any combination.

Further provided herein is a method of managing treatment of endometriosis and/or infertility and/or endometriosis derived ovarian cancer in a subject, comprising: a) obtaining a first sample from the subject; b) detecting a level of expression of a SIRT1 gene and/or protein in the sample; c) detecting a level of expression of a K-ras gene and/or protein in the sample; d) comparing the level of expression detected in (b) with the level of expression of a SIRT1 gene and/or protein in a sample obtained from a control subject or a population of control subjects; e) comparing the level of expression detected in (c) with the level of expression of a K-ras gene and/or protein in a sample obtained from a control subject or a population of control subjects; f) diagnosing the subject as having endometriosis and/or infertility when the subject has a level of expression of the SIRT1 gene and/or protein greater than the level of expression of the SIRT1 gene and/or protein of the control subject or population of control subjects, and a level of expression of the K-ras gene and/or protein greater than the level of expression of the K-ras gene and/or protein of the control subject or population of control subjects; g) treating the endometriosis and/or infertility and/or endometriosis derived ovarian cancer in the subject; h) obtaining a subsequent sample from the subject at one or more time points following step (g); i) detecting a level of expression of a SIRT1 gene and/or protein in the subsequent sample; j) detecting a level of expression of a K-ras gene and/or protein in the subsequent sample; and k) comparing the level of expression of the SIRT1 gene and/or protein detected in (b) with the level of expression of the SIRT1 gene and/or protein detected in (i) and comparing the level of expression of the K-ras gene and/or protein detected in (c) with the level of expression of the K-ras gene and/or protein detected in (j), wherein a decrease in (i) relative to (b) and a decrease in (j) relative to (c) in a subject indicates that the treatment can be halted or reduced, and an increase or no change in (i) relative to (b) and an increase or no change in (j) relative to (c) indicates that the treatment can be continued or increased.

Additionally provided herein is a method for managing treatment of endometriosis and/or infertility in a subject, comprising: a) obtaining a first sample from the subject; b) detecting a level of expression of a SIRT1 gene and/or protein in the first sample; c) calculating an HSCORE for the subject based on the level of expression of the SIRT1 protein in the first sample; d) detecting a level of expression of a K-ras gene and/or protein in the first sample; e) calculating an HSCORE for the subject based on the level of expression of the K-ras protein in the first sample; f) diagnosing the subject as having endometriosis and/or infertility when the subject has an HSCORE based on the level of expression of the SIRT1 protein that is greater than a pre-determined cut-off value and an HSCORE based on the level of expression of the K-ras protein that is greater than a pre-determined cut-off level; g) treating the endometriosis and/or infertility in the subject; h) obtaining a subsequent sample from the subject at one or more time points following step (g); i) detecting a level of expression of a SIRT1 gene and/or protein in the subsequent sample; j) calculating an HSCORE for the subject based on the level of expression of the SIRT1 protein in the subsequent sample; k) detecting a level of expression of a K-ras gene and/or protein in the subsequent sample; l) calculating an HSCORE for the subject based on the level of expression of the K-ras protein in the subsequent sample; and m) comparing the HSCORE of (c) with the HSCORE of (j) and comparing the HSCORE of (e) with the HSCORE of (l), wherein a decrease in the HSCORE of (j) relative to the HSCORE of (c), along with a decrease in the HSCORE of (1) relative to the HSCORE of (e) indicates that the treatment of the endometriosis and/or infertility can be halted or reduced, and no change or an increase in the HSCORE of (j) relative to the HSCORE of (c) to a value greater than or equal to a pre-determined cut-off value, along with either no change or an increase in the HSCORE of (1) relative to the HSCORE of (e) indicates that treatment of the endometriosis and/or infertility can be continued or increased.

The present invention also provides a method for identifying an increased risk for implantation failure associated with in vitro fertilization (IVF) and/or frozen embryo transfer (FET) in a subject, comprising: a) obtaining a sample from the subject; b) detecting a level of expression of a SIRT1 gene and/or protein in the sample, optionally by contacting the sample with a monoclonal antibody that specifically binds an epitope within amino acids 577-590 of the human SIRT1 protein having the amino acid sequence of SEQ ID NO:164;

c) detecting a level of expression of a K-ras gene and/or protein in the sample;

d) comparing the level of expression detected in (b) with the level of expression of a SIRT1 gene and/or protein in a sample obtained from a control subject or population of control subjects;

e) comparing the level of expression detected in (c) with the level of expression of a K-ras gene and/or protein in a sample obtained from a control subject or a population of control subjects;

f) identifying the subject as having an increased risk of implantation failure associated with in vitro fertilization (IVF) and/or frozen embryo transfer when the subject has a level of expression of the SIRT1 gene and/or protein greater than the level of expression of the SIRT1 gene and/or protein of the control subject or population of control subjects, and has a level of expression of the K-ras gene and/or protein that is greater than the level of expression of the K-ras gene and/or protein of the control subject or population of control subjects.

The present invention also provides a method for identifying an increased risk for implantation failure subsequent to in vitro fertilization (IVF) and/or frozen embryo transfer (FET) in a subject, comprising: a) obtaining a sample from the subject; b) detecting a level of expression of a SIRT1 gene and/or protein in the sample optionally by contacting the sample with a monoclonal antibody that specifically binds an epitope within amino acids 577-590 of the human SIRT1 protein having the amino acid sequence of SEQ ID NO:164; c) calculating an HSCORE for the subject based on the level of expression detected in (b); d) detecting a level of expression of a K-ras gene and/or protein in the sample; e) calculating an HSCORE for the subject based on the level of expression detected in (d); and f) identifying the subject as having an increased risk of implantation failure subsequent to in vitro fertilization (IVF) and/or frozen embryo transfer when the subject has an HSCORE calculated for a level of expression of a SIRT1 protein that is greater than a pre-determined cut-off value, and an HSCORE calculated for the level of expression of a K-ras protein that is greater than a pre-determined cut-off value.

Further provided herein is a method of diagnosing infertility in a subject, comprising: a) obtaining a sample from the subject; b) detecting a level of expression of a SIRT1 gene and/or protein in the sample optionally by contacting the sample with a monoclonal antibody that specifically binds an epitope within amino acids 577-590 of the human SIRT1 protein having the amino acid sequence of SEQ ID NO:164;

c) detecting a level of expression of a BCL6 gene and/or protein in the sample; d) comparing the level of expression detected in (b) with the level of expression of a SIRT1 gene and/or protein in a sample obtained from a control subject or a population of control subjects; e) comparing the level of expression detected in (c) with the level of expression of a BCL6 gene and/or protein in a sample obtained from a control subject or a population of control subjects; and f) diagnosing the subject as having infertility when the subject has a level of expression of the SIRT1 gene and/or protein greater than the level of expression of the SIRT1 gene and/or protein of the control subject or population of control subjects and also has a level of expression of the BCL6 gene and/or protein that is greater than the level of expression of the BCL6 gene and/or protein of the control subject or population of control subjects.

Also provide herein is a method of diagnosing infertility in a subject, comprising: a) obtaining a sample from the subject; b) detecting a level of expression of a SIRT1 gene and/or protein in the sample optionally by contacting the sample with a monoclonal antibody that specifically binds an epitope within amino acids 577-590 of the human SIRT1 protein having the amino acid sequence of SEQ ID NO:164; c) calculating an HSCORE for the subject based on the level of expression of the SIRT1 protein detected in (b); d) detecting a level of expression of a BCL6 gene and/or protein in the sample; e) calculating an HSCORE for the subject based on the level of expression of the BCL6 protein detected in (d); and f) diagnosing the subject as having infertility when the subject has an HSCORE calculated for a level of expression of a SIRT1 protein that is greater than a pre-determined cut-off value, and an HSCORE calculated for a level of expression of a BCL6 protein that is greater than a pre-determined cut-off value.

Also provided herein is a method of diagnosing endometriosis in a subject, comprising: a) obtaining a sample from the subject; b) detecting a level of expression of a SIRT1 gene and/or protein in the sample optionally by contacting the sample with a monoclonal antibody that specifically binds an epitope within amino acids 577-590 of the human SIRT1 protein having the amino acid sequence of SEQ ID NO:164; c) detecting a level of expression of a BCL6 gene and/or protein in the sample; d) comparing the level of expression detected in (b) with the level of expression of a SIRT1 gene and/or protein in a sample obtained from a control subject or a population of control subjects; e) comparing the level of expression detected in (c) with the level of expression of a BCL6 gene and/or protein in a sample obtained from a control subject or a population of control subjects; and f) diagnosing the subject as having endometriosis when the subject has a level of expression of the SIRT1 gene and/or protein greater than the level of expression of the SIRT1 gene and/or protein of the control subject or population of control subjects, and has a level of expression of the BCL6 gene and/or protein that is greater than the level of expression of the BCL6 gene and/or protein of the control subject or population of control subjects.

The present invention further provides a method of diagnosing endometriosis in a subject, comprising: a) obtaining a sample from the subject; b) detecting a level of expression of a SIRT1 gene and/or protein in the sample optionally by contacting the sample with a monoclonal antibody that specifically binds an epitope within amino acids 577-590 of the human SIRT1 protein having the amino acid sequence of SEQ ID NO:164; c) calculating an HSCORE for the subject based on the level of expression detected in (b); d) detecting a level of expression of a BCL6 gene and/or protein in the sample; e) calculating an HSCORE for the subject based on the level of expression detected in (d); and f) diagnosing the subject as having endometriosis when the subject has an HSCORE calculated for a level of expression of a SIRT1 protein that is greater than a pre-determined cut-off value, and an HSCORE calculated for the level of expression of a BCL6 protein that is greater than a pre-determined cut-off value.

The present invention additionally provides a method of diagnosing endometriosis derived ovarian cancer in a subject, comprising: a) obtaining a sample from the subject; b) detecting a level of expression of a SIRT1 gene and/or protein in the sample optionally by contacting the sample with a monoclonal antibody that specifically binds an epitope within amino acids 577-590 of the human SIRT1 protein having the amino acid sequence of SEQ ID NO:164; c) detecting a level of expression of a K-ras gene and/or protein in the sample; d) comparing the level of expression detected in (b) with the level of expression of a SIRT1 gene and/or protein in a sample obtained from a control subject or a population of control subjects; e) comparing the level of expression detected in (c) with the level of expression of a K-ras gene and/or protein in a sample obtained from a control subject or a population of control subjects; and f) diagnosing the subject as having endometriosis derived ovarian cancer when the subject has a level of expression of the SIRT1 gene and/or protein greater than the level of expression of the SIRT1 gene and/or protein of the control subject or population of control subjects and also has a level of expression of the K-ras gene and/or protein that is greater than the level of expression of the K-ras gene and/or protein of the control subject or population of control subjects.

The present invention also provides a method of diagnosing and treating endometriosis derived ovarian cancer in a subject, comprising: a) obtaining a sample from the subject; b) detecting a level of expression of a SIRT1 gene and/or protein in the sample optionally by contacting the sample with a monoclonal antibody that specifically binds an epitope within amino acids 577-590 of the human SIRT1 protein having the amino acid sequence of SEQ ID NO:164; c) calculating an HSCORE for the subject based on the level of expression of the SIRT1 protein detected in (b); d) detecting a level of expression of a K-ras gene and/or protein in the sample; e) calculating an HSCORE for the subject based on the level of expression of the K-ras protein detected in (d); and f) diagnosing the subject as having endometriosis derived ovarian cancer when the subject has an HSCORE calculated for a level of expression of a SIRT1 protein that is greater than a pre-determined cut-off value, and an HSCORE calculated for a level of expression of a K-ras protein that is greater than a pre-determined cut-off value.

Furthermore the present invention provides a method of diagnosing infertility in a subject, comprising: a) obtaining a sample from the subject; b) detecting a level of expression of a SIRT1 gene and/or protein in the sample optionally by contacting the sample with a monoclonal antibody that specifically binds an epitope within amino acids 577-590 of the human SIRT1 protein having the amino acid sequence of SEQ ID NO:164; c) detecting a level of expression of a K-ras gene and/or protein in the sample; d) comparing the level of expression detected in (b) with the level of expression of a SIRT1 gene and/or protein in a sample obtained from a control subject or a population of control subjects; e) comparing the level of expression detected in (c) with the level of expression of a K-ras gene and/or protein in a sample obtained from a control subject or a population of control subjects; and f) diagnosing the subject as having infertility when the subject has a level of expression of the SIRT1 gene and/or protein greater than the level of expression of the SIRT1 gene and/or protein of the control subject or population of control subjects and also has a level of expression of the K-ras gene and/or protein that is greater than the level of expression of the K-ras gene and/or protein of the control subject or population of control subjects.

The present invention also provides a method of diagnosing infertility in a subject, comprising: a) obtaining a sample from the subject; b) detecting a level of expression of a SIRT1 gene and/or protein in the sample optionally by contacting the sample with a monoclonal antibody that specifically binds an epitope within amino acids 577-590 of the human SIRT1 protein having the amino acid sequence of SEQ ID NO:164; c) calculating an HSCORE for the subject based on the level of expression of the SIRT1 gene and/or protein detected in (b); d) detecting a level of expression of a K-ras gene and/or protein in the sample; e) calculating an HSCORE for the subject based on the level of expression of the K-ras protein detected in (d); and f) diagnosing the subject as having infertility when the subject has an HSCORE calculated for a level of expression of a SIRT1 protein that is greater than a pre-determined cut-off value, and an HSCORE calculated for a level of expression of a K-ras protein that is greater than a pre-determined cut-off value.

Additionally, the present invention provides a method of managing treatment of endometriosis and/or infertility and/or endometriosis derived ovarian cancer in a subject, comprising: a) obtaining a first sample from the subject; b) detecting a level of expression of a SIRT1 gene and/or protein in the sample; c) detecting a level of expression of a K-ras gene and/or protein in the sample; d) treating the endometriosis and/or infertility and/or endometriosis derived ovarian cancer in the subject; e) obtaining a subsequent sample from the subject at one or more time points following step (d); f) detecting a level of expression of a SIRT1 gene and/or protein in the subsequent sample; g) detecting a level of expression of a K-ras gene and/or protein in the subsequent sample; and h) comparing the level of expression of the SIRT1 gene and/or protein detected in (b) with the level of expression of the SIRT1 gene and/or protein detected in (f) and comparing the level of expression of the K-ras gene and/or protein detected in (c) with the level of expression of the K-ras gene and/or protein detected in (g), wherein a decrease in (f) relative to (b) and a decrease in (g) relative to (c) in a subject indicates that the treatment can be halted or reduced, and an increase or no change in (f) relative to (b) and an increase or no change in (g) relative to (c) indicates that the treatment can be continued or increased.

Further provided herein is a method for managing treatment of endometriosis and/or infertility and/or endometriosis derived ovarian cancer in a subject, comprising: a) obtaining a first sample from the subject; b) detecting a level of expression of a SIRT1 gene and/or protein in the first sample; c) calculating an HSCORE for the subject based on the level of expression of the SIRT1 protein in the first sample; d) detecting a level of expression of a K-ras gene and/or protein in the first sample; e) calculating an HSCORE for the subject based on the level of expression of the K-ras protein in the first sample; f) treating the endometriosis and/or infertility and/or endometriosis derived ovarian cancer in the subject; g) obtaining a subsequent sample from the subject at one or more time points following step (f); h) detecting a level of expression of a SIRT1 gene and/or protein in the subsequent sample; i) calculating an HSCORE for the subject based on the level of expression of the SIRT1 protein in the subsequent sample; j) detecting a level of expression of a K-ras gene and/or protein in the subsequent sample; k) calculating an HSCORE for the subject based on the level of expression of the K-ras protein in the subsequent sample; and l) comparing the HSCORE of (c) with the HSCORE of (i) and comparing the HSCORE of (e) with the HSCORE of (k), wherein a decrease in the HSCORE of (i) relative to the HSCORE of (c), along with a decrease in the HSCORE of (k) relative to the HSCORE of (e) indicates that the treatment of the endometriosis and/or infertility can be halted or reduced, and no change or an increase in the HSCORE of (i) relative to the HSCORE of (c) to a value greater than or equal to a pre-determined cut-off value, along with either no change or an increase in the HSCORE of (k) relative to the HSCORE of (e) indicates that treatment of the endometriosis and/or infertility can be continued or increased.

The present invention further provides a method of managing treatment of endometriosis and/or infertility in a subject, comprising: a) obtaining a first sample from the subject; b) detecting a level of expression of a SIRT1 gene and/or protein in the sample; c) detecting a level of expression of a BCL6 gene and/or protein in the sample; d) treating the endometriosis and/or infertility; e) obtaining a subsequent sample from the subject at one or more time points following step (d); f) detecting a level of expression of a SIRT1 gene and/or protein in the subsequent sample; g) detecting a level of expression of a BCL6 gene and/or protein in the subsequent sample; and h) comparing the level of expression of the SIRT1 gene and/or protein detected in (b) with the level of expression of the SIRT1 gene and/or protein detected in (f) and comparing the level of expression of the BCL6 gene and/or protein detected in (c) with the level of expression of the BCL6 gene and/or protein detected in (g), wherein a decrease in (f) relative to (b) and a decrease in (g) relative to (c) in a subject indicates that the treatment can be halted or reduced, and an increase or no change in (f) relative to (b) and an increase or no change in (g) relative to (c) indicates that the treatment can be continued or increased.

The present invention also provides a method for managing treatment of endometriosis and/or infertility in a subject, comprising: a) obtaining a first sample from the subject; b) detecting a level of expression of a SIRT1 gene and/or protein in the first sample; c) calculating an HSCORE for the subject based on the level of expression of the SIRT1 protein in the first sample; d) detecting a level of expression of a BCL6 gene and/or protein in the first sample; e) calculating an HSCORE for the subject based on the level of expression of the BCL6 protein in the first sample; f) treating the endometriosis and/or infertility in the subject; g) obtaining a subsequent sample from the subject at one or more time points following step (f); h) detecting a level of expression of a SIRT1 gene and/or protein in the subsequent sample; i) calculating an HSCORE for the subject based on the level of expression of the SIRT1 protein in the subsequent sample; j) detecting a level of expression of a BCL6 gene and/or protein in the subsequent sample; k) calculating an HSCORE for the subject based on the level of expression of the BCL6 protein in the subsequent sample; and l) comparing the HSCORE of (c) with the HSCORE of (i) and comparing the HSCORE of (e) with the HSCORE of (k), wherein a decrease in the HSCORE of (i), along with a decrease in the HSCORE of (k) indicates that the treatment of the endometriosis and/or infertility can be halted or reduced, and no change or an increase in the HSCORE of (i) to a value greater than or equal to a pre-determined cut-off value, along with either no change or an increase in the HSCORE of (k) indicates that treatment of the endometriosis and/or infertility can be continued or increased.

In the methods described herein, the phrase "treatment . . . can be halted or reduced" includes the active step of halting or reducing said treatment. Also, the phrase "treatment . . . can be continued or increased" includes the active step of continuing or increasing said treatment.

Also provided herein is a method of diagnosing and treating endometriosis derived ovarian cancer in a subject, comprising: a) obtaining a sample from the subject; b) detecting a level of expression of a SIRT1 gene and/or protein in the sample; c) detecting a level of expression of a K-ras gene and/or protein in the sample; d) comparing the level of expression detected in (b) with the level of expression of a SIRT1 gene and/or protein in a sample obtained from a control subject or a population of control subjects; e) comparing the level of expression detected in (c) with the level of expression of a K-ras gene and/or protein in a sample obtained from a control subject or a population of control subjects; f) diagnosing the subject as having endometriosis derived ovarian cancer when the subject has a level of expression of the SIRT1 gene and/or protein greater than the level of expression of the SIRT1 gene and/or protein of the control subject or population of control subjects and also has a level of expression of the K-ras gene and/or protein that is greater than the level of expression of the K-ras gene and/or protein of the control subject or population of control subjects; and g) administering to the subject an effective amount of a K-ras inhibitor and/or a treatment that blocks or reduces K-ras activity and/or an effective amount of a SIRT1 inhibitor and/or a treatment that blocks or reduces SIRT1 activity, singly or in any combination.

The present invention also provides a method of diagnosing and treating endometriosis derived ovarian cancer in a subject, comprising: a) obtaining a sample from the subject; b) detecting a level of expression of a SIRT1 gene and/or protein in the sample; c) calculating an HSCORE for the subject based on the level of expression of the SIRT1 protein detected in (b); d) detecting a level of expression of a K-ras gene and/or protein in the sample; e) calculating an HSCORE for the subject based on the level of expression of the K-ras protein detected in (d); f) diagnosing the subject as having endometriosis derived ovarian cancer when the subject has an HSCORE calculated for a level of expression of a SIRT1 protein that is greater than a pre-determined cut-off value, and an HSCORE calculated for a level of expression of a K-ras protein that is greater than a pre-determined cut-off value; and g) administering to the subject an effective amount of a K-ras inhibitor and/or a treatment that blocks or reduces K-ras activity and/or an effective amount of a SIRT1 inhibitor and/or a treatment that blocks or reduces SIRT1 activity, singly or in any combination.

Further provided herein is a method of treating endometriosis derived ovarian cancer in a subject in need thereof, comprising administering to a subject having overexpression of a SIRT1 gene and/or protein and a K-ras gene and/or protein an effective amount of a K-ras inhibitor and/or a treatment that blocks or reduces K-ras activity and/or an effective amount of a SIRT1 inhibitor and/or a treatment that blocks or reduces SIRT1 activity and/or by surgical removal of some or all of the endometriosis and/or administration to the subject of an effective amount of a gonadotropin-releasing hormone (GnRH) agonist, singly or in any combination.

Additionally, the present invention provides a method for identifying a subject as having an increased risk of having or developing endometriosis derived ovarian cancer, comprising: a) obtaining a sample from the subject; b) detecting a level of expression of a SIRT1 gene and/or protein in the sample, optionally by contacting the sample with a monoclonal antibody that specifically binds an epitope within amino acids 577-590 of the human SIRT1 protein having the amino acid sequence of SEQ ID NO:164; c) detecting a level of expression of a K-ras gene and/or protein in the sample; d) comparing the level of expression detected in (b) with the level of expression of a SIRT1 gene and/or protein in a sample obtained from a control subject or a population of control subjects; e) comparing the level of expression detected in (c) with the level of expression of a K-ras gene and/or protein in a sample obtained from a control subject or a population of control subjects; f) identifying the subject as having an increased risk of having or developing endometriosis derived ovarian cancer when the subject has a level of expression of the SIRT1 gene and/or protein greater than the level of expression of the SIRT1 gene and/or protein of the control subject or population of control subjects, and has a level of expression of the K-ras gene and/or protein that is greater than the level of expression of the K-ras gene and/or protein of the control subject or population of control subjects.

A method is also provided herein for identifying a subject as having an increased risk of having or developing endometriosis derived ovarian cancer, comprising: a) obtaining a sample from the subject; b) detecting a level of expression of a SIRT1 gene and/or protein in the sample optionally by contacting the sample with a monoclonal antibody that specifically binds an epitope within amino acids 577-590 of the human SIRT1 protein having the amino acid sequence of SEQ ID NO:164; c) calculating an HSCORE for the subject based on the level of expression detected in (b); d) detecting a level of expression of a K-ras gene and/or protein in the sample; e) calculating an HSCORE for the subject based on the level of expression detected in (d); and f) identifying the subject as having an increased risk of having or developing endometriosis derived ovarian cancer when the subject has an HSCORE calculated for a level of expression of a SIRT1 protein that is greater than a pre-determined cut-off value, and an HSCORE calculated for the level of expression of a K-ras protein that is greater than a pre-determined cut-off value.

In the methods described herein that recite an HSCORE, the HSCORE is calculated using the following equation: HSCORE=Σ Pi (i+1)/100, where i=the intensity of staining of cells in the sample with a value of 1 being low staining, 2 being moderate staining, and 3 being strong staining, and Pi being the percentage of stained cells in the sample for each intensity, varying from 0-100%.

In the methods of this invention that recite a predetermined cut-off value, said pre-determined cut-off value can be 1.0, 1.1, 1.2, 1.3, 1.4, 1.5, 1.6, 1.7, 1.8, 1.9, or 2.0.

It would be understood by one of skill in the art that the methods of this invention can be readily adapted to identify a subject having a poor prognosis for ovarian cancer and also to identify an effective and/or optimal treatment or therapy for a subject of this invention that has the markers described herein.

The present invention further provides a monoclonal antibody that specifically binds an epitope within amino acids 577-590 of the human SIRT1 protein having the amino acid sequence of SEQ ID NO:164. By "within amino acids 577-590" it is meant that the epitope comprises, consists essentially of or consists of some or all of the amino acid residues 577, 578, 579, 580, 581, 582, 583, 584, 585, 586, 587, 588, 589 and 590 in the amino acid sequence of SEQ ID NO:164.

I. General Considerations

Endometriosis is associated with biological changes in the eutopic endometrium including increased epithelial cell proliferation and inflammation and a decrease of apoptosis and responses to progesterone, also known as progesterone resistance (Young & Lessey, 2010). BCL6 (B Cell Lymphoma 6) is a transcriptional repressor and is necessary for B cell development and oncogenesis (Cattoretti et al., 1995; Hurtz et al., 2011; Basso & Dalla-Favera, 2012). BCL6 has six Krüppel-type zinc finger domains and a BTB/POZ (bric-á-brac, tramtrack, broad complex/pox virus zinc finger) domain, which can bind to transcriptional factors including Interferon Regulatory Factor (IRF) 4 and BCL6-associated zinc finger (BAZF; Okabe et al., 1998; Gupta et al., 1999; Dent et al., 2002). BCL6 is one of the human proto-oncogenes and is associated with an increase in cell proliferation through the repression of genes such as p53 and p300 (Phan & Dalla-Favera, 2004; Cerchietti et al., 2010). BCL6 DNA binding site (TTCCT(A/C)GAA) is similar with Signal Transduction and Activators of Transcription (STAT) factors and BCL6 can repress transcription via STAT factor binding sites and thus inhibit cytokine-induced transcription (Seyfert et al., 1996; Dent et al., 1997; Harris et al., 1999). Furthermore, BCL6 is upregulated by STAT3 (Arguni et al., 2006). STAT3 signaling is aberrantly activated in eutopic endometrium from women with endometriosis compared to those without this disease (Kim et al., 2015).

Recently, it was reported that BCL6 is highly expressed in endometrium from women with endometriosis during the secretory phase of the menstrual cycle compared to women without endometriosis (Evans-Hoeker et al., 2016; see also PCT International Patent Application Publication No. WO 2015/143228, incorporated by reference herein in its entirety). However, the underlying mechanisms of BCL6 have not been studied enough in endometriosis.

BCL6 has a function as a transcriptional repressor through interaction between its BTB/POZ domain with BCL6 corepressor (BCoR), nuclear receptor corepressor (NCoR) 1 and 2, and the histone deacetylase (HDAC) protein complex (Huynh & Bardwell, 1998; Huynh et al., 2000). BCL6 and BCoR complexes with Sirtuin 1 (SIRT1) to directly repress the Sonic Hedgehog effectors GLI1 and GLI2, and blocks the growth of human medulloblastoma (Tiberi et al., 2014). SIRT1 is a member of the sirtuin family of proteins and homologs to the yeast Sir2 protein. Sirtuin family proteins are Class III HDACs (Frye, 1999). SIRT1 can deacetylate both histones and non-histone proteins such as p53 (Imai, 2001; Luo et al., 2001). Its deacetylation activity enables it to regulate gene transcription and implicates in the influence of a variety of cellular processes such as aging, apoptosis, inflammation, stress resistance, and metabolism (Preyat and Leo, 2013; Milisav et al., 2015, Poulose & Raju, 2015). Interestingly, SIRT1 has a dual role as oncogenic function as well as tumor suppressor (Song & Surh, 2012). SIRT1 may also play a role as a tumor promoter in endometrial cancer by targeting sterol regulatory element binding protein 1 (SREBP1) and lipogenesis (Lin et al., 2014). Additionally, SIRT1 has an important role in the regulation of inflammatory cytokines expression in endometriotic stromal cells (Taguchi et al., 2014).

Disclosed herein are investigations of the levels of SIRT1 proteins in endometrium from women with and without endometriosis. As disclosed herein, the levels of SIRT1 were significantly higher in endometrium of endometriosis patients compared to women without the disease. Furthermore, a strong positive correlation was found between SIRT1 and BCL6 expression in the endometrium of endometriosis patients, and protein interactions between SIRT1 and BCL6 in human endometrial tissue were observed. As such, the results presented herein suggest that aberrant overexpression of SIRT1 and its relationship with BCL6 play an important role in the pathogenesis of endometriosis.

II. Definitions

While the following terms are believed to be well understood by one of ordinary skill in the art, the following definitions are set forth to facilitate explanation of the presently disclosed subject matter.

Following long-standing patent law convention, the terms "a" and "an" mean "one or more" when used in this application, including the claims.

Unless otherwise indicated, all numbers expressing quantities of size, biomarker concentration, probability, percentage, and so forth used in the specification and claims are to be understood as being modified in all instances by the term "about". For example, the amounts can vary by about 10%, 5%, 1%, or 0.5%. Accordingly, unless indicated to the contrary, the numerical parameters set forth in this specification and attached claims are approximations that can vary depending upon the desired properties sought to be obtained by the presently disclosed subject matter.

The term "and/or" when used in describing two or more items or conditions refers to situations where all named items or conditions are present or applicable, or to situations wherein only one (or less than all) of the items or conditions is present or applicable.

As used herein, the term "BCL6" refers to the B-cell lymphoma 6 gene (also referred to as the B-cell CLL/lymphoma 6 gene; gene symbol BCL6) as well as gene products encoded and/or derived therefrom. In humans, the BCL6 gene is present on chromosome 3. Exemplary human BCL6 gene products include, but are not limited to the nucleotide sequences disclosed in the GENBANK® biosequence database at Accession Nos. NM_001706 (transcript variant 1; SEQ ID NO: 1), NM_001130845 (transcript variant 2; SEQ ID NO: 3), and NM_001134738 (transcript variant 3; (SEQ ID NO: 5), which encode the amino acid sequences disclosed in GENBANK® biosequence database Accession Nos. NP_001697 (SEQ ID NO: 2), NP_001124317 (SEQ ID NO: 4), and NP_001128210 (SEQ ID NO: 6), respectively. The term "BCL6" also corresponds to orthologs of human BCL6 from other species, including but not limited to those set forth in Table 1.

As used herein, the term "beta3" refers to the beta 3 integrin gene (also referred to as the platelet glycoprotein IIIa gene and the antigen CD61 gene; gene symbol ITGB3) as well as gene products encoded and/or derived therefrom. In humans, the beta3 gene is present on chromosome 17. Exemplary human beta3 gene products include, but are not limited to the nucleotide sequences disclosed in the GENBANK® biosequence database at Accession Nos. NM_000212 (SEQ ID NO: 73) and M35999 (SEQ ID NO: 75), which encode the amino acid sequences disclosed in GENBANK® biosequence database Accession Nos. NP_000203 (SEQ ID NO: 74) and AAA35927 (SEQ ID NO: 76), respectively. The term "beta3" also corresponds to orthologs of human beta3 from other species, including but not limited to those set forth in Table 2.

As used herein, the terms "sirtuin 1" and "SIRT1" refers to the sirtuin 1 gene (gene symbol SIRT1) as well as gene products encoded and/or derived therefrom. In humans, the SIRT1 gene is present on chromosome 10. Exemplary human SIRT1 gene products include, but are not limited to the nucleotide sequences disclosed in the GENBANK® biosequence database at Accession Nos. NM_012238 (SEQ ID NO: 117) and NM_001142498 (SEQ ID NO: 119), which encode the amino acid sequences disclosed in GENBANK® biosequence database Accession Nos. NP_036370 (SEQ ID NO: 118) and NP_001135970 (SEQ ID NO: 120), respectively. The term "SIRT1" also corresponds to orthologs of human SIRT1 from other species, including but not limited to those set forth in Table 3.

As used herein, the term "comprising", which is synonymous with "including", "containing", and "characterized by," is inclusive or open-ended and does not exclude additional, unrecited elements and/or method steps. "Comprising" is a term of art that means that the named elements and/or steps are present, but that other elements and/or steps can be added and still fall within the scope of the relevant subject matter.

As used herein, the phrase "consisting of" excludes any element, step, or ingredient not specified in the claim. When the phrase "consists of" appears in a clause of the body of a claim, rather than immediately following the preamble, it limits only the element set forth in that clause; other elements are not excluded from the claim as a whole.

As used herein, the phrase "consisting essentially of" limits the scope of a claim to the specified materials or steps, plus those that do not materially affect the basic and novel characteristic(s) of the claimed subject matter.

With respect to the terms "comprising", "consisting essentially of", and "consisting of", where one of these three terms is used herein, the presently disclosed subject matter can include the use of either of the other two terms. For example, the presently disclosed subject matter relates in some embodiments to for detecting the presence of endometriosis, subfertility, or both endometriosis and subfertility in a subject, which methods comprise detecting the presence or absence of biomarkers BCL6, beta3, or both BCL6 and beta3 in a sample from the subject. It is understood that the presently disclosed subject matter thus also encompasses methods that in some embodiments consist essentially of detecting the presence or absence of biomarkers BCL6, beta3, or both BCL6 and beta3 in a sample from the subject; as well as methods that in some embodiments consist of detecting the presence or absence of biomarkers BCL6, beta3, or both BCL6 and beta3 in a sample from the subject.

"Amino acid sequence" and terms such as "peptide", "polypeptide", and "protein" are used interchangeably herein, and are not meant to limit the amino acid sequence to the complete, native amino acid sequence (i.e. a sequence containing only those amino acids found in the protein as it occurs in nature) associated with the recited protein molecule. The proteins and protein fragments of the presently disclosed subject matter can be produced by recombinant approaches or can be isolated from a naturally occurring source. The protein fragments can be any size, and for example can range in size from four amino acid residues to the entire amino acid sequence minus one amino acid.

The terms "antibody" and "immunoglobulin" include antibodies or immunoglobulins of any isotype, fragments of antibodies that retain specific binding to antigen, including but not limited to Fab, Fv, scFv, and Fd fragments, chimeric antibodies, humanized antibodies, single-chain antibodies, and fusion proteins including an antigen-binding portion of an antibody and a non-antibody protein. The antibodies can in some embodiments be detectably labeled, e.g., with a radioisotope, an enzyme which generates a detectable product, a fluorescent protein, and the like. The antibodies can in some embodiments be further conjugated to other moieties, such as members of specific binding pairs, e.g., biotin (member of biotin-avidin specific binding pair), and the like. Also encompassed by the terms are Fab', Fv, F(ab')$_2$, and other antibody fragments that retain specific binding to antigen (e.g., any antibody fragment that comprises at least one paratope).

Antibodies can exist in a variety of other forms including, for example, Fv, Fab, and (Fab')$_2$, as well as bi-functional (i.e., bi-specific) hybrid antibodies (see e.g., Lanzavecchia et al., 1987) and in single chains (see e.g., Huston et al., 1988 and Bird et al., 1988, each of which is incorporated herein by reference in its entirety). See generally, Hood et al., 1984, and Hunkapiller & Hood, 1986. The phrase "detection molecule" is used herein in its broadest sense to include any molecule that can bind with sufficient specificity to a biomarker to allow for detection of the particular biomarker. To allow for detection can mean to determine the presence or absence of the particular biomarker member and, in some embodiments, can mean to determine the amount of the particular biomarker. Detection molecules can include antibodies, antibody fragments, and nucleic acid sequences.

The term "antibodies" as used herein refers to all types of immunoglobulins, including IgG, IgM, IgA, IgD, and IgE. The term "immunoglobulin" includes the subtypes of these immunoglobulins, such as IgG$_1$, IgG$_2$, IgG$_3$, IgG$_4$, etc. Of these immunoglobulins, IgM and IgG are preferred, and IgG is particularly preferred. The antibodies may be of any species of origin, including (for example) mouse, rat, rabbit, horse, or human, or may be chimeric antibodies. See, e.g., M. Walker et al., *Molec. Immunol.* 26, 403-11 (1989). Such monoclonal antibodies are produced in accordance with known techniques. The term "antibody" as used herein includes antibody fragments which retain the capability of binding to a target antigen, for example, Fab, F(ab')$_2$, and Fv fragments, and the corresponding fragments obtained from antibodies other than IgG. Such fragments are also produced by known techniques.

Monoclonal antibodies may be recombinant monoclonal antibodies produced according to the methods disclosed in Reading U.S. Pat. No. 4,474,893, or Cabilly et al., U.S. Pat. No. 4,816,567. The antibodies may also be chemically constructed by specific antibodies made according to the method disclosed in Segel et al., U.S. Pat. No. 4,676,980 (Applicants specifically intend that the disclosure of all U.S. patent references cited herein be incorporated herein by reference in their entirety).

Monoclonal antibodies may be chimeric or "humanized" antibodies produced in accordance with known techniques. For example, chimeric monoclonal antibodies may be complementarily determining region-grafted antibodies (or "CDR-grafted antibodies") produced in accordance with known techniques. Antibodies of this invention can also be attached to moieties (e.g., pegylated with a polyalkylene glycol such as polyethylene glycol (PEG)) to facilitate delivery, expand half life, improve solubility, etc, as are known in the art.

An example of an antibody of this invention is a monoclonal antibody that specifically binds an epitope within amino acids 577-590 (wherein within means that the end amino acid residues 577 and 590 may be included among the residues that make up the epitope).

Monoclonal Fab fragments may be produced in *Escherichia coli* by recombinant techniques known to those skilled in the art. See, e.g., W. Huse, *Science* 246, 1275-81 (1989).

Antibodies for use in the present invention specifically bind to their target with a relatively high binding affinity, for example, with a dissociation constant of about $10^{-6}$ or $10^{-8}$ up to $10^{-12}$ or $10^{-13}$.

Humanized monoclonal antibodies are a further aspect of the present invention. A humanized antibody of the present invention may be produced from antibodies as described herein by any suitable technique, using a conventional complementarity determining region (CDR)-grafting method as disclosed in EPO Publication No. 0239400 and U.S. Pat. Nos. 6,407,213; 6,180,370; and 5,693,762, all of which are incorporated herein by reference in their entirety. Alternatively, a humanized antibody may be produced by directly modifying antibody variable regions without diminishing the native affinity of the domain for antigen while reducing its immunogenicity with respect to a heterologous species (see, e.g., U.S. Pat. No. 5,766,886 which is incorporated herein by reference in its entirety).

Using a CDR-grafting method, the humanized antibody is generally produced by combining a human framework region (FR) with one or more CDRs from a non-human (usually a mouse or rat) immunoglobulin which are capable of binding to a predetermined antigen.

Typically, the humanized antibody comprises substantially all of at least one, and typically two, variable domains (Fab, Fab', F(ab')$_2$, Fabc, Fv) in which all or substantially all of the CDR correspond to those of a non-human immunoglobulin and all or substantially all of the FR are those of a human immunoglobulin consensus sequence. The humanized antibody optimally also comprises at least a portion of an immunoglobulin constant region (Fc), typically that of a human immunoglobulin. Ordinarily, the antibody contains both the light chain as well as at least the variable domain of a heavy chain. The antibody also may include the CH1, hinge, CH2, CH3, and CH4 regions of the heavy chain The humanized antibody may be selected from any class of immunoglobulins, including IgM, IgG, IgD, IgA and IgE, and any isotype, including IgG$_1$, IgG$_2$, IgG$_3$ and IgG$_4$. Usually the constant domain is a complement fixing constant domain where it is desired that the humanized antibody exhibit cytotoxic activity, and the class is typically IgG$_1$. Where such cytotoxic activity is not desirable, the constant domain may be of the IgG$_2$ class. The humanized antibody may comprise sequences from more than one class or isotype, and selecting particular constant domains to optimize desired effector functions is within the ordinary skill in the art.

The FR and CDR of the humanized antibody need not correspond precisely to the parental sequences, however, it is preferable that substitutions, insertions or deletions not be extensive. Usually, at least 75% of the humanized antibody residues should correspond to those of the parental FR and CDR sequences, more often 90%, and most preferably greater than 95%.

The term "antibody" or "antibodies" as used herein refers to all types of immunoglobulins, including IgG, IgM, IgA, IgD, and IgE. The antibody can be monoclonal or polyclonal and can be of any species of origin, including (for example) mouse, rat, rabbit, horse, goat, sheep, camel, or human, or can be a chimeric antibody. See, e.g., Walker et al., *Molec. Immunol.* 26:403 (1989). The antibodies can be recombinant monoclonal antibodies produced according to the methods disclosed in U.S. Pat. Nos. 4,474,893 or 4,816,567. The antibodies can also be chemically constructed according to the method disclosed in U.S. Pat. No. 4,676,980.

Antibody fragments included within the scope of the present invention include, for example, Fab, Fab', F(ab')$_2$, and Fv fragments; domain antibodies, diabodies; vaccibodies, linear antibodies; single-chain antibody molecules; and multispecific antibodies formed from antibody fragments. Such fragments can be produced by known techniques. For example, F(ab')$_2$ fragments can be produced by pepsin digestion of the antibody molecule, and Fab fragments can be generated by reducing the disulfide bridges of the F(ab')$_2$ fragments. Alternatively, Fab expression libraries can be constructed to allow rapid and easy identification of monoclonal Fab fragments with the desired specificity (Huse et al., Science 254:1275 (1989)).

Antibodies of the invention may be altered or mutated for compatibility with species other than the species in which the antibody was produced. For example, antibodies may be humanized, caninized, felinized, equinized, or camelized. Humanized forms of non-human (e.g., murine) antibodies are chimeric immunoglobulins, immunoglobulin chains or fragments thereof (such as Fv, Fab, Fab', F(ab')$_2$ or other antigen-binding subsequences of antibodies) which contain minimal sequence derived from non-human immunoglobulin. Humanized antibodies include human immunoglobulins (recipient antibody) in which residues from a complementarity determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the framework (FR) regions (i.e., the sequences between the CDR regions) are those of a human immunoglobulin consensus sequence. The humanized antibody optimally also will comprise at least a portion of an immunoglobulin constant region (Fc), typically that of a human immunoglobulin (Jones et al., Nature 321:522 (1986); Riechmann et al., Nature, 332:323 (1988); and Presta, Curr. Op. Struct. Biol. 2:593 (1992)).

Methods for humanizing non-human antibodies are well known in the art. Generally, a humanized antibody has one or more amino acid residues introduced into it from a source which is non-human. These non-human amino acid residues are often referred to as "import" residues, which are typically taken from an "import" variable domain. Humanization can essentially be performed following the method of Winter and co-workers (Jones et al., Nature 321:522 (1986); Riechmann et al., Nature 332:323 (1988); Verhoeyen et al., Science 239:1534 (1988)), by substituting rodent CDRs or CDR sequences for the corresponding sequences of a human antibody. Accordingly, such "humanized" antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues (e.g., all of the CDRs or a portion thereof) and possibly some FR residues are substituted by residues from analogous sites in rodent antibodies.

Human antibodies can also be produced using various techniques known in the art, including phage display libraries (Hoogenboom and Winter, J. Mol. Biol. 227:381 (1991); Marks et al., J. Mol. Biol. 222:581 (1991)). The techniques of Cole et al. and Boerner et al. are also available for the preparation of human monoclonal antibodies (Cole et al., Monoclonal Antibodies and Cancer Therapy, Alan R. Liss, p. 77 (1985) and Boerner et al., J. Immunol. 147:86 (1991)). Similarly, human antibodies can be made by introducing human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in the following scientific publications: Marks et al., Bio/Technology 10:779 (1992); Lonberg et al., Nature 368:856 (1994); Morrison, Nature 368:812 (1994); Fishwild et al., Nature Biotechnol. 14:845 (1996); Neuberger, Nature Biotechnol. 14:826 (1996); Lonberg and Huszar, Intern. Rev. Immunol. 13:65 (1995).

Polyclonal antibodies used to carry out the present invention can be produced by immunizing a suitable animal (e.g., rabbit, goat, etc.) with an antigen to which a monoclonal antibody to the target binds, collecting immune serum from the animal, and separating the polyclonal antibodies from the immune serum, in accordance with known procedures.

Monoclonal antibodies used to carry out the present invention can be produced in a hybridoma cell line according to the technique of Kohler and Milstein, Nature 265:495 (1975). For example, a solution containing the appropriate antigen can be injected into a mouse and, after a sufficient time, the mouse sacrificed and spleen cells obtained. The spleen cells are then immortalized by fusing them with myeloma cells or with lymphoma cells, typically in the presence of polyethylene glycol, to produce hybridoma cells. The hybridoma cells are then grown in a suitable medium and the supernatant screened for monoclonal antibodies having the desired specificity. Monoclonal Fab fragments can be produced in E. coli by recombinant techniques known to those skilled in the art. See, e.g., Huse, Science 246:1275 (1989).

Antibodies specific to the target polypeptide can also be obtained by phage display techniques known in the art.

Various immunoassays can be used for screening to identify antibodies having the desired specificity for the polypeptides of this invention. Numerous protocols for competitive binding or immunoradiometric assays using either polyclonal or monoclonal antibodies with established specificity are well known in the art. Such immunoassays typically involve the measurement of complex formation between an antigen and its specific antibody (e.g., antigen/antibody complex formation). A two-site, monoclonal-based immunoassay utilizing monoclonal antibodies reactive to two non-interfering epitopes on the polypeptides or peptides of this invention can be used as well as a competitive binding assay.

Antibodies can be conjugated to a solid support (e.g., beads, plates, slides or wells formed from materials such as latex or polystyrene) in accordance with known techniques. Antibodies can likewise be conjugated to detectable groups such as radiolabels (e.g., $^{35}$S, $^{125}$I, $^{131}$I), enzyme labels (e.g., horseradish peroxidase, alkaline phosphatase), and fluorescence labels (e.g., fluorescein) in accordance with known techniques. Determination of the formation of an antibody/antigen complex in the methods of this invention can be by detection of, for example, precipitation, agglutination, flocculation, radioactivity, color development or change, fluorescence, luminescence, etc., as is well known in the art.

The phrase "detection molecule" is used herein in its broadest sense to include any molecule that can bind with sufficient specificity to a biomarker to allow for detection of the particular biomarker. To allow for detection can mean to determine the presence or absence of the particular biomarker member and, in some embodiments, can mean to determine the amount of the particular biomarker. Detection molecules can include, but are not limited to antibodies, antibody fragments, and nucleic acid sequences.

As used herein, the term "sample" is used in its broadest sense. In one sense, it is meant to include a specimen from a biological source. Biological samples can be obtained from animals (including humans) and encompass fluids (e.g., blood, mucus, urine, saliva), solids, tissues, cells, and gases. The sample can comprise fluids or washings of the uterine lining or sample prepared by similar techniques involving cervical lavage or brushings. The presence of BCL6 in blood may also provide a surrogate marker for the presence of this marker in the endometrium or its associated tissues.

The phrase "specific binding partner for each of the detection molecules" is used herein to include any molecule that binds with sufficient specificity to one of the detection molecules to allow for detection of the particular detection molecule. For example, in some embodiments the specific binding partner can be a secondary antibody that recognizes the detection molecule that is a primary antibody. In some embodiments the specific binding partner can be a molecule that specifically binds to a group on the detection molecule such as, for example, a biotin group on the detection molecule.

As used herein, the term "subject" refers to any animal, including but not limited to any mammal, such as but not limited to humans, non-human primates, rodents, and the like, which is to be the recipient of a particular treatment. The terms "subject" and "patient" are in some embodiments used interchangeably herein, such as but not limited to in reference to a human subject or patient.

A sample of this invention can be any biological sample in which BCL6, SIRT1, and/or KRAS genes and/or proteins can be detected. Nonlimiting examples of a sample of this invention include blood, serum, plasma, endometrium, cervical swab, saliva, tears, vaginal secretion, urine, any body fluid, breast milk or secretion, exudate, secretion, lavage, washing, tissue, biological matter, cavity fluid and the like.

As used herein, the term "fertility treatment" refers to any procedure, therapy or protocol to facilitate and/or increase the likelihood of fertilization. Nonlimiting examples of a fertility treatment of this invention include in vitro fertilization (IVF), frozen embryo transplant (FET), fresh embryo transplant, intrauterine insemination, artificial insemination, fertility drugs, assisted reproductive technology (ART), intracytoplasmic sperm injection (ICSI), gamete intrafallopian tube transfer (GIFT), zygote intrafallopian tube transfer (ZIFT), donor egg transfer, timed intercourse, etc., as are known in the art.

As used herein, the term "endometriosis derived ovarian cancer" refers to ovarian cancer derived from endometriosis or endometrial tissue. In some embodiments, the ovarian cancer can be a type 1 ovarian cancer. In some embodiments, the ovarian cancer can be endometrioid ovarian cancer. In some embodiments, the ovarian cancer can be clear cell ovarian cancer. Treatment of endometriosis derived ovarian cancer of this invention can comprise the treatments described herein and/or known treatments for ovarian cancer.

Nonlimiting examples of treatment for endometriosis and/or endometriosis derived ovarian cancer include surgical removal of ectopic lesions and/or hormonal suppression focused on reducing estrogen, such as progestins, androgens, gonadotropin-releasing hormone (GnRH) agonists, and aromatase inhibitors, which are the current gold standards of therapy. ERK pathway inhibitors may also have a role in the treatment of endometriosis. Estrogen has been shown to increase SIRT1, paralleled by a decrease in PPAR-g. Indirectly, estrogen may be increased by activation of Cox2 and aromatase by IL17, thus aromatase inhibitors, estrogen antagonists or cytokine (IL17) inhibitors may each be potential therapeutic options for treatment. Aromatase inhibitors have been shown to improve IVF success rates in the setting of IVF specifically in women with endometrial receptivity problems. Thus anti-estrogens or even anti-androgens or other specific SERMs or SARMs might be useful to target this pathway, as well as other means to inhibit the AKT pathway. Other therapies may also target this pathway including doxycycline.

As used herein, the phrase "recurrent pregnancy loss" (RPL) refers to a condition when a woman experiences two or more consecutive pregnancy losses prior to 20 weeks (see a discussion on the website of the American Society for Reproductive Medicine). RPL is a major health concern to women, affecting about 17% of couples wishing to have children. The diagnostic evaluation of RPL is extensive and complex, with many different etiologies, each causing a small proportion of the total cases. The etiologies can be grouped into five categories: anatomic, infectious, hormonal, immunological, and genetic, thereby requiring the collaborative efforts of many medical specialists. It has been estimated that the specific cause for RPL remains unknown in 37-79% of affected women (Stephenson, 1996). See also U.S. Pat. No. 6,268,145, incorporated herein by reference in its entirety.

As used herein, the phrase "progesterone-resistance" (P-resistance) refers to a condition wherein normal levels of progesterone elicit a subnormal or reduced response. P-resistance can occur at the level of the progesterone receptor isoforms (PR-A and PR-B; Igarashi et al., 2005; Attia et al., 2000), steroid receptor co-activators, or downstream effectors (TGFβ, DKK-1, Retinoic acid, c-myc, etc). In endometriotic lesions, a decrease in the expression of the progesterone target gene 17-beta hydroxysteroid dehydrogenase type I is evidence of P-resistance in ectopic endometrium (Vierikko et al., 1985; Bulun et al., 2006). Studies are conflicting regarding the normalcy of circulating levels of progesterone in women with endometriosis (Brosenset al., 1978; Cheesman et al., 1983; Williams et al., 1986; Kusuhara, 1992; Cunha-Filho et al., 2003), and this discrepancy may be secondary to difficulties in both ascertainment and interpretation of circulating progesterone levels. A single serum progesterone level may not be representative of luteal adequacy (Abraham et al., 1974; Laufer et al., 1982), and successful intrauterine pregnancy has been documented with mid-luteal P levels as low as 3-4 ng/ml (Costello et al., 2004). Finally, a study of luteal endometrial differentiation in programmed cycles of physiologic and subphysiologic exogenous progesterone replacement in GnRH agonist-suppressed healthy volunteers showed no differences in endometrial thickness, histology, or epithelial integrin expression at the lower serum progesterone level (Usadi et al., 2003). This finding supports the argument that the reduced progesterone response in the eutopic endometrium of women with endometriosis is an intrinsic biologic alteration of the endometrium. A model for progesterone resistance based on differential PR isoform expression has been described for ectopic endometrium (Bulun et al., 2006), and a reduced responsiveness to progesterone in eutopic endometrium has been implicated in disease pathogenesis (Osteen et al., 2005). See also U.S. Pat. Nos. 7,871,778; 8,247,174; 9,175,349.

As used herein, the terms "subfertility/infertility" "subfertility" and "infertility" and grammatical variations thereof, refer to the condition of being less than normally fertile, which can be further characterized as a prolonged period of non-conception. In some cases, a subfertile subject can still capable of effecting conception. However, in other cases, the term "subfertility" is also meant to encompass an infertile subject. The term "subfertility" can also pertain to a condition whereby a person can conceive but not successfully complete the pregnancy, as in miscarriage or recurrent abortion. The term "subfertility" is also meant to encompass difficulties with regard to embryo implantation, including but not limited to embryo implantation related to in vitro fertilization (IVF) treatment and/or with respect to frozen embryo transfer (FET).

The endometrium is a dynamic, hormone responsive tissue that undergoes repetitive proliferation, differentiation, apoptosis, tissue breakdown, and repair to support its major function of regulating embryo implantation. These dynamic changes are orchestrated, directly and indirectly, by the sex steroids estrogen and progesterone, and mediated by paracrine factors, including classical immune system cytokines and chemokines (Large & Demayo, 2012). Sex steroids, cytokines, and chemokines also regulate cyclic changes in the numbers, proportions, and phenotypes of endometrial leukocytes, which can make up as much as 40% of the cellular mass of the human endometrium.

Inflammation and altered endometrial gene expression leading to infertility is now a recognized syndrome of progesterone resistance (Aghajanova et al., 2010; Lessey et al., 2013). Endometriosis is an inflammatory condition and a leading cause of infertility, affecting an estimated 176 million women worldwide (Adamson et at, 2010; Guidice, 2010; Holoch & Lessey, 2010). While decreased fertility due to problems with ovum pickup and transport is an established mechanism in women with more severe endometriosis, the basis for widespread infertility in milder forms of endometriosis remains poorly understood. Evidence to date suggests that abnormal endometrial function, associated with altered cellular immunity and resistance to progesterone signaling could be a major factor contributing to reduced receptivity to embryo implantation (Lessey & Young, 2014).

Integrins are a family of cell surface receptors for extracellular matrix (ECM) proteins and are believed to play key roles in the adhesion and motility of cells. Implantation involves complex alterations in the integrin expression in both the endometrium and the trophoblast, which are likely involved in attachment and invasion at the maternal-fetal interface. The instant co-inventors initially demonstrated that specific integrin expression patterns were present only during the putative window of implantation and that the loss of key integrins such as the αvβ3 vitronectin receptor in the glandular and luminal endometrial epithelium was associated with certain types of infertility (see Lessey et al., 1992). Those preliminary studies suggested that β3 integrin could be employed as a marker of uterine receptivity.

Delayed or aberrant expression has been observed in the endometrium of infertile women with luteal phase defect (Lessey et al., 1992), endometriosis (Lessey et al., 1994a), tubal disease with hydrosalpinges (Meyer et al., 1997), and unexplained infertility (Lessey et al., 1995). Therapy that results in improvement in pregnancy rates has been shown to restore normal β3 integrin subunit expression (Meyer et al., 1997).

Over the ensuing years, β3 integrin subunit testing for endometrial receptivity (E-TEGRITY® brand β3 integrin subunit test; Innovative Reproductive Solutions, Boston, Mass., United States of America) has detected women with defects in endometrial receptivity due to endometriosis and other inflammatory conditions such as hydrosalpinges. The E-TEGRITY® brand β3 integrin subunit test is widely used, with approximately 100 tests performed per month around the world. This test, however, has several key shortcomings. Since normal endometrial β3 integrin subunit expression only occurs after cycle day 20, all samples with histological delay lack this biomarker regardless of receptivity status (Creus et al., 2002). This leads to a blind spot in the testing when histology lags behind the time of the biopsy. While a positive test (missing beta3 integrin subunit when the histopathology is normal) has an excellent predictive value for implantation failure, it has now become apparent that many women with infertility and endometriosis still express the β3 integrin subunit normally, even when endometrial receptivity defects exist. Thus the test lacks sensitivity despite its high specificity.

Global gene profiling has identified the B-cell chronic lymphocytic leukemia (CLL)/lymphoma 6 (BCL6) gene product as a regulated secretory protein in human endometrium (Talbi et al., 2006; Burney et al., 2009). BCL6 is a proto-oncogene and transcriptional repressor that contributes to cell cycle control and differentiation and apoptosis inhibition (Kumagai et al., 1999; Kojima et al., 2001). Its expression is typically associated with increased proliferation (Shaffer et al., 2000), and it is overexpressed in many cancers. Mechanistic studies have demonstrated that BCL6 can also regulate cytokine expression, including interleukin (IL)-1, IL-6, IL-18, and colony stimulating factor-1 (CSF-1), all of which have been implicated in regulation of embryo implantation (Takeda et al., 2003; Yu et al., 2005; Chaouat et al., 2007). Further, recent evidence has linked BCL6 to interference in the sonic hedgehog pathway, specifically through down-regulation of Gli-1 (Tiberi et al., 2014), a pathway in common with progesterone signaling and the Indian Hedgehog pathway in endometrium (Wei et al., 2010). As such, the instant disclosure provides that BCL6 is a suspected mediator of progesterone resistance and therefore a primary cause of infertility due to inflammatory conditions such as but not limited to endometriosis and hydrosalpinges.

BCL6 is a zinc finger transcription factor that acts as a sequence-specific repressor of transcription, which in T-cells promotes formation of memory B-cells. Endometriosis is a common, sometimes debilitating disorder that is a frequent cause of pain and infertility. The disease, found in greater than 5% of all reproductive age women, is characterized by lesions in the peritoneal cavity that closely resemble the endometrium found inside the uterine cavity. Currently, there is no reliable diagnostic test for endometriosis except surgical exploration. This is undesirable for several reasons, not least because one does not want to perform exploratory surgery on someone without disease that itself can be addressed surgically, which now occurs frequently. In addition, endometriosis contributes to the majority of unexplained infertility, which when not discovered, can lead to expensive and often unsuccessful therapies. An accurate test for endometriosis could also provide new opportunities for non-surgical (i.e., medical) management. A diagnostic test that also comprises the root cause of the infertility might also provide new opportunities for novel therapies directed at progesterone resistance.

In accordance with the presently disclosed subject matter, expression of the SIRT1 and BCL6 genes has been observed to be markedly elevated in the uterine endometrium of women with endometriosis in both the proliferative and secretory phases relative to women its expression in the uterine endometrium of women who do not have endometriosis. In women with endometriosis, SIRT1 (over)expression is very clearly evident at the protein level as assessed by immunohistochemistry in the proliferative and secretory phases, wherein BCL6 gene (over)expression is evident at the protein level as assessed by immunohistochemistry in the secretory phase, whereas SIRT1 and BCL6 staining is virtually absent in normal patients (i.e., women without endometriosis). Accordingly, in some embodiments, endometrial tissue can be assessed for SIRT1 mRNA and/or protein expression, optionally in conjunction with BCL6 mRNA and/or protein expression, as a diagnostic test for the presence or absence of endometriosis at any point of the menstrual cycle. In some embodiments these assays are performed during the secretory phase, where endometrial biopsy is preferred at least in part because during the proliferative phase the subject has not yet ovulated and cannot, therefore, be in very early pregnancy when a biopsy might disturb an implanting embryo.

In some embodiments, the presently disclosed subject matter utilizes SIRT1 as a first biomarker that is highly sensitive to the presence of endometriosis, and in some embodiments utilizes a second biomarker (i.e., BCL6) and in some embodiments also a third biomarker (i.e., the beta3 integrin subunit) that are specific for uterine causes of infertility, which in some embodiments can be combined with traditional histo-morphological feature assessment. These tests can be performed, for example, on formalin fixed, paraffin embedded tissue sections using hematoxylin and eosin staining (H&E staining or HE staining) in combination with immunostaining for SIRT1 and optionally BCL6 and further optionally also beta3.

BCL6 expression has been examined in subjects at various stages of the menstrual cycle (see PCT International Patent Application Publication No. WO 2015/143228). Normal endometrium and endometrium from women with endometriosis were examined, and it was discovered that BCL6 was dramatically (for example, 5-10 fold) elevated in eutopic endometrium of women with endometriosis. It was at first studied in the proliferative phase since no expression of BCL6 is normally present during this early phase of the menstrual cycle. In the secretory phase, some expression is present normally. Immunostaining of many samples was performed in both phases in normal women and women with endometriosis. It is felt that both phases are acceptable times to use BCL6 as a marker for endometriosis.

Beta3 integrin expression has also been examined (see PCT International Patent Application Publication No. WO 2015/143228). It was determined that the BCL6 test disclosed therein provided additional information over beta3 integrin testing alone. Particularly, it was observed that a negative test (i.e., a positive beta3 result, meaning that beta3 is being expressed at a normal level) can be misleading and can become non-informative for the diagnosis of endometriosis or other causes of endometrial receptivity defects under certain conditions. Overexpression of BCL6 (for example, an expression level that is above a defined HSCORE cut-off) in the presence or the absence of beta3 expression was an indication that endometriosis was present at any stage of disease. The lack of beta3 expression in an in phase histologically normal endometrium could have additional meaning for implantation failure, as with IVF and/or FET.

Thus, the presence of SIRT1 and optionally BCL6 is exquisitely sensitive to the presence of endometriosis even in its mildest forms. In some embodiments, the presently disclosed biomarker tests are employed on endometrial biopsy samples. In some embodiments, the presently disclosed biomarker tests are employed in less invasive techniques such as endometrial or cervical lavage, endometrial brushings, and/or even a blood test.

In accordance with some embodiments of the presently disclosed subject matter, methods for identifying a subject as a candidate for implantation of an embryo are provided. As used herein, the phrase "candidate for implantation of an embryo" refers in some embodiments to a subfertile subject (who in some embodiments can be an infertile subject) who is attempting to get pregnant or be impregnated via an assisted reproductive technology (ART) that involves transferring an embryo into the uterus of the subject. In some embodiments, the embryo was produced by in vitro fertilization, and in some embodiments the embryo was a frozen embryo that is being transferred into the subject via frozen embryo transfer. As disclosed herein, candidates for implantation of an embryo are those subjects who, by employing the methods and compositions disclosed herein, are likely to have receptive endometrium.

Subjects that are likely to have receptive endometrium include those who do not have endometriosis. As set forth herein, the presence of endometriosis correlates strongly with SIRT1 overexpression and, in some embodiments, concurrent BCL6 overexpression during the second half of the menstrual cycle. As such, in some embodiments the presently disclosed methods comprise determining whether or not a particular subject has endometriosis by determining whether or not the subject overexpresses SIRT1 at any stage of her menstrual cycle, and optionally further comprise determining whether BCL6 overexpression is present during the second half of her menstrual cycle.

In some embodiments of the presently disclosed methods, identifying a subject as a candidate for implantation of an embryo comprises providing a sample of endometrium from a subject, wherein the sample comprises endometrium isolated from the subject (in some embodiments during the second half of the subject's menstrual cycle); and detecting a level of expression of an SIRT1 gene product and, in some embodiments, a BCL6 gene product, in the sample, wherein overexpression of the SIRT1 gene product in the sample, optionally concurrently with overexpression of the BCL6 gene product in the sample, as compared to expression of the SIRT1 and optionally BCL6 gene products in a sample of similarly timed endometrium isolated from a normally fertile control subject is indicative of reduced receptivity of the endometrium in the subject. A subject who does not overexpress SIRT1 and/or does not overexpress BCL6 at the relevant time are thus likely to have receptive endometrium, and is thus identified as a candidate for implantation of an embryo.

More particularly, in some embodiments a method for identifying a subject as a candidate for implantation of an embryo comprises providing a sample of endometrium from a subject, wherein the sample comprises endometrium isolated from the subject (in some embodiments during the second half of the subject's menstrual cycle); detecting a level of expression of an SIRT1 gene product, optionally also of a BCL6 gene product, and further optionally a level of expression of a beta3 integrin gene product in the sample; determining whether or not the endometrium of the subject is in phase or out of phase; correlating the expression level or expression levels detected and whether or not the endometrium of the subject is in phase or out of phase with receptivity of the endometrium of the subject; and determining whether the subject is a candidate for implantation of an embryo based on the correlating step, wherein the determining step identifies the subject as a candidate for implantation of an embryo.

The presently disclosed subject matter also provides methods for identifying an increased risk for implantation failure in a subject, in some embodiments identifying an increased risk for implantation failure subsequent to in vitro fertilization (IVF) and/or frozen embryo transfer (FET). In some embodiments, the presently disclosed methods comprise determining an SIRT1 status, optionally a BCL6 status, and further optionally a beta3 status, and a endometrial phase status for a subject (including but not limited to a subject undergoing IVF and/or FET treatment), wherein an abnormal SIRT1 status and an abnormal BCL6 status (if determined) in the subject and/or an abnormal beta3 status accompanied by in phase histological phase status is indicative of increased risk for implantation failure in the subject.

As used herein, the phrase "SIRT1 status" refers to an assessment of SIRT1 expression in the endometrium of a subject, in some embodiments in the endometrium of a subject during the first half of the subject's menstrual cycle, and in some embodiments in the endometrium of a subject during the second half of the subject's menstrual cycle. In some embodiments, a subject's SIRT1 status is considered normal if the level of expression of SIRT1 in the endometrium of the subject is within the range of normal variation seen in subjects of the same species at the same point in their menstrual cycles. In some embodiments, a subject's SIRT1 status is considered abnormal if the level of expression of SIRT1 in the endometrium of the subject is higher than a pre-selected cut-off relative to normal variation seen in subjects of the same species at the same point in their menstrual cycles. In some embodiments, the pre-selected cut-off is an HSCORE calculated as set forth herein.

As used herein, the phrase "BCL6 status" refers to an assessment of BCL6 expression in the endometrium of a subject, in some embodiments in the endometrium of a subject during the second half of the subject's menstrual cycle. In some embodiments, a subject's BCL6 status is considered normal if the level of expression of BCL6 in the endometrium of the subject is within the range of normal variation seen in subjects of the same species at the same point in their menstrual cycles. In some embodiments, a subject's BCL6 status is considered abnormal if the level of expression of BCL6 in the endometrium of the subject is higher than a pre-selected cut-off relative to normal variation seen in subjects of the same species at the same point in their menstrual cycles. In some embodiments, the pre-selected cut-off is an HSCORE calculated as set forth herein.

As used herein, the phrase "beta3 status" refers to an assessment of beta3 expression in the endometrium of a subject, in some embodiments in the endometrium of a subject during the second half of the subject's menstrual cycle. In some embodiments, a subject's beta3 status is considered normal if the level of expression of beta3 in the endometrium of the subject is within the range of normal variation seen in subjects of the same species at the same point in their menstrual cycles. In some embodiments, a subject's beta3 status is considered abnormal if the level of expression of beta3 in the endometrium of the subject is below a pre-selected cut-off relative to normal variation seen in subjects of the same, species at the same point in their menstrual cycles. In some embodiments, the pre-selected cut-off is an HSCORE calculated as set forth herein.

As used herein, the phrase "endometrial phase status" refers to whether the subject's endometrium is in phase or out of phase. Endometrial phase is determined in some embodiments by histological analysis of endometrial biopsies at particular stages of the menstrual cycle. Histology "in phase" means that the histomorphology of the endometrium is reflective of the day of the cycle the endometrial biopsy was taken. The histomorphology of the endometrium changes in a characteristic manner through the cycle, allowing one to assign a "cycle day" to the subject. When endometrium is out of phase, the histomorphology of the biopsy appears as though the biopsy was taken at an earlier cycle day. In some embodiments, a subject's endometrial phase status is deemed out of phase if an endometrial biopsy is more than 2 or in some embodiments more than 3 days out of phase. Conversely, in some embodiments a subject's endometrial phase status is deemed in phase if an endometrial biopsy is less than 2 or in some embodiments less than 3 days out of phase. Stated another way, a subject's endometrial phase status can be determined by evaluating endometrial biopsies in the context of timing of ovulation and/or the onset of the next menstrual period. In some embodiments, samples are judged as "out of phase" if histologic dating was delayed by 2 or in some embodiments 3 or more days relative to the predicted day of the menstrual cycle, and/or if subnuclear vacuoles are present.

The presently disclosed subject matter also provides methods for detecting endometrial receptivity to embryo implantation in a subject, optionally a subfertile subject. The phrase "endometrial receptivity" refers to a period in which the endometrium acquires an ability to receive an embryo and allow it to successfully implant therein. In humans, the endometrium acquires this state simultaneously with the development of decidualization in the stromal compartment (Popovici et al., 2000), which is mainly due to the presence of progesterone after proper sensitization with 17P-estradiol. This period, called the "window of implantation", typically lasts from 4-5 days to 9-10 days after production of or progesterone administration in humans The receptive window in humans is thus limited in this way to menstrual cycle days 19-24 (Navot et al., 1991).

Generally, the endometrial receptivity occurs during a period of the menstrual cycle in which BCL6 gene expression is induced (i.e., during the second half of the menstrual cycle). Endometrial receptivity is negatively affected by the presence of endometriosis, however (see Olive & Schwartz, 1993), and reports from several in vitro fertilization (IVF)/embryo transfer programs indicate patients with endometriosis have decreased implantation rates (Hahn et al., 1986; Simón et al., 1994; Arici et al., 1996). As disclosed herein, SIRT1 overexpression, and in some embodiments both SIRT1 overexpression and BCL6 overexpression, is associated with the presence of endometriosis, and thus SIRT1, either alone or in combination with BCL6, can be employed as a biomarker for the presence of endometriosis and hence, can also be employed for detecting endometrial receptivity to embryo implantation.

As such, in some embodiments a method for detecting endometrial receptivity to embryo implantation comprises determining whether or not a subject seeking to undergo an assisted reproductive technology involving embryo transfer overexpresses SIRT1 during her menstrual cycle, and optionally also overexpresses BCL6 during the second half of her menstrual cycle. In some embodiments, such a methods comprises (a) obtaining a sample of endometrium from the subject, wherein if BCL6 expression is to be determined, the sample is isolated from the subject during the second half of the subject's menstrual cycle; (b) detecting an expression level of an SIRT1 gene product in the sample and if desired, also determining an expression level of a BCL6 gene product in the sample; and (c) correlating the expression level of the SIRT1 gene product and optionally also the BCL6 gene product in the sample with endometrial receptivity, wherein overexpression of the SIRT1 gene product in the sample as compared to expression of the SIRT1 gene product in a sample of endometrium isolated from a normally receptive control subject is indicative of reduced receptivity of the endometrium in the subject. In those embodiments were BCL6 gene expression is also determined, overexpression of both the SIRT1 gene product and the BCL6 gene product as compared to expression of these gene products in a sample of endometrium isolated from a normally receptive control subject is indicative of reduced receptivity of the endometrium in the subject.

Since the presence of endometriosis has been associated with infertility, the presently disclosed subject matter also provides methods for facilitating a diagnosis of infertility in a mammal. Here as well, in some embodiments a method for facilitating a diagnosis of infertility in a mammal comprises determining whether or not a subject overexpresses SIRT1 during her menstrual cycle, and optionally further comprises determining whether or not the subject overexpresses BCL6 during the second half of her menstrual cycle. In some embodiments, the presently disclosed methods comprise (a) obtaining a sample of endometrium from the mammal, wherein the sample is isolated from the mammal during the mammal's menstrual cycle; (b) detecting expression of SIRT1 in the sample; and (c) correlating overexpression of SIRT1 in the sample with infertility. In some embodiments, the presently disclosed methods further comprise (a) obtaining a sample of endometrium from the mammal, wherein the sample is isolated from the mammal during the second half of the mammal's menstrual cycle; (b) detecting expression of BCL6 in the sample; and (c) correlating overexpression of both SIRT1 and BCL6 in the sample with infertility.

Furthermore, as disclosed herein, SIRT1 and BCL6 are specific and sensitive biomarkers for the presence of endometriosis in a subject. As such, the presently disclosed subject matter also provides methods for detecting the presence of endometriosis in a subject by determining whether or not a subject overexpresses SIRT1, optionally both SIRT1 and BCL6, during her menstrual cycle. In some embodiments, the presently disclosed methods comprise providing a sample of endometrium from the subject, wherein the sample comprises endometrium isolated from the subject during the subject's menstrual cycle; detecting a level of expression of an SIRT1 gene product in the sample; and correlating the expression level of the SIRT1 gene product in the sample with the presence of endometriosis in the subject, wherein overexpression of the SIRT1 gene product in the sample as compared to expression of the SIRT1 gene product in a sample of similarly timed endometrium isolated from a normal control subject is indicative of the presence of endometriosis in the subject. In some embodiments, the presently disclosed methods further comprise providing a sample of endometrium from the subject, wherein a first sample comprises endometrium isolated from the subject during the second half of the subject's menstrual cycle; detecting a level of expression of a BCL6 gene product in the sample; and correlating the expression levels of both the SIRT1 gene product and the BCL6 gene product in the sample with the presence of endometriosis in the subject, wherein overexpression of both the SIRT1 gene product and the BCL6 gene product in the sample or samples as compared to expression of the SIRT1 and BCL6 gene products in the sample(s) of similarly timed endometrium isolated from a normal control subject is indicative of the presence of endometriosis in the subject.

Additionally, in some embodiments the presently disclosed subject matter provides methods for managing treatment of a subject with potential endometriosis, subfertility, recurrent pregnancy loss, progesterone-resistance, or any combination thereof. In some embodiments, the presently disclosed methods comprise providing a subject suspected of having endometriosis, subfertility, recurrent pregnancy loss, progesterone-resistance, or any combination thereof; detecting the presence or absence of the biomarker SIRT1 in a sample from the subject, and managing the treatment of the subject based on the detecting step. In some embodiments, the presently disclosed methods further comprise detecting the presence or absence of the biomarker BCL6 in a sample from the subject, and managing the treatment of the subject based on the combined detecting step with respect to both SIRT1 and BCL6. In some embodiments, the presently disclosed subject matter further comprise optionally also detecting the presence of absence of the biomarker beta3 in a sample from the subject; and managing the treatment of the subject based on the detecting of SIRT1, BCL6, and beta3.

Managing treatment can comprise selecting appropriate time frames in which to schedule additional studies, such as, but not limited to biopsies and surgery, for the subject. Managing treatment can further comprise selecting an appropriate time frame in which to schedule a repeat assessment of biomarker level(s). Managing treatment can comprise monitoring a fertility patient's receptivity to implantation based on the SIRT1 biomarker, optionally also based on the BCL6 biomarker, and further optionally also based on the beta3 biomarker, as well as identifying infertility patients who will be helped by surgery using the SIRT1 biomarker, optionally in conjunction with the BCL6 biomarker and further optionally also in conjunction with the beta3 biomarker. In some embodiments, managing treatment can comprise monitoring success of a particular treatment for endometriosis and thus guiding the physician to consider a different treatment for a particular patient (based on repeated testing, for example).

Disclosed herein is the observation that overexpression of SIRT1 or SIRT1 and BCL6 (for example, expression that is associated with an HSCORE above a pre-selected cut-off) is highly sensitive for the presence of endometriosis, and further implies the need for surgical management and/or retest to show effectiveness of surgery. It is noted that some endometrioses are difficult to detect because the endometriosis is deep within the tissue and/or because the lesions are small and/or are diffusely present.

In some embodiments, strong SIRT1 staining (i.e., SIRT1 expression that exceeds a pre-determined cut-off) correlates with endometriosis-related infertility due to endometrial dysfunction. In such cases and in some embodiments, surgery to treat infertility can be warranted. In some embodiments, a combination of strong SIRT1 staining in conjunction with strong BCL6 staining (i.e., BCL6 expression that exceeds a pre-determined cut-off) correlates with endometriosis-related infertility due to endometrial dysfunction. In such cases and in some embodiments, surgery to treat infertility can be warranted. In some embodiments, a combination of strong SIRT1 staining in conjunction with strong BCL6 staining and absent beta3 staining (i.e., beta3 expression that does not exceed a pre-determined cut-off) correlates with endometriosis-related infertility due to endometrial dysfunction.

In some embodiments, it was observed that absent SIRT1 staining, optionally in combination with absent BCL6 and/or absent beta3 staining (with histomorphology consistent with early secretory phase or proliferative phase) is non-diagnostic.

In accordance with some embodiments of the presently disclosed subject matter, provided is a method for monitoring a fertility patient's receptivity to implantation based on one (i.e., SIRT1), or optionally two (i.e., SIRT1 and BCL6), or optionally three (i.e., SIRT1, BCL6, and beta3) biomarkers, as well as a method for identifying infertility patients who will be helped by surgery and/or medical treatment(s) using the same one, optionally, two, and further optionally three markers.

In accordance with the presently disclosed subject matter, SIRT1 is highly sensitive, and highly specific, either alone or in combination with BCL6. In some embodiments, SIRT1 either alone or in combination with BCL6, is a marker for endometrial dysfunction (greatly reduced receptivity to embryo implantation). By far, the disorder frequently seen in association with endometrial dysfunction (and its likely cause) is endometriosis. However, hydrosalpinx, which causes similar endometrial dysfunction, is also associated with positive BCL6 staining. So, in accordance with some embodiments of the presently disclosed subject matter, provided is a test for endometriosis and/or endometrial dysfunction in infertile women. In some embodiments, SIRT1, either alone or in combination with BCL6, can be employed as a biomarker in women who are not trying to conceive.

Beta3 testing, such as in the fairly rare Type II defect, can be highly specific, but also can be poorly sensitive for an implantation defect. In some embodiments of the presently disclosed subject matter, beta3 provides additional specificity and sensitivity, particularly when positive, when used in combination with SIRT1 alone or SIRT1 and BCL6 together.

The presence and/or expression level of each of the presently disclosed biomarkers can be determined in a variety of animal tissues. In some embodiments, the biomarkers can be detected and/or quantified in animal tissue or bodily fluids. In some embodiments, the biomarkers can be detected and/or quantified in tissue.

Any suitable method can be employed for determining the presence and/or expression level of each of the biomarkers, as would be apparent to one skilled in the art upon a review of the present disclosure. For example, methods for detecting and/or quantified biomarkers can include, but are not limited to, polymerase chain reaction (PCR)-based techniques, gas chromatography (GC), liquid chromatography/mass spectroscopy (LC-MS), gas chromatography/mass spectroscopy (GC-MS), nuclear magnetic resonance (NMR), magnetic resonance imaging (MRI), Fourier Transform InfraRed (FT-IR), and inductively coupled plasma mass spectrometry (ICP-MS). It is further understood that mass spectrometry techniques include, but are not limited to, the use of magnetic-sector and double focusing instruments, transmission quadrapole instruments, quadrupole ion-trap instruments, time-of-flight instruments (TOF), Fourier transform ion cyclotron resonance instruments (FT-MS), and matrix-assisted laser desorption/ionization time-of-flight mass spectrometry (MALDI-TOF MS).

In some embodiments, protein biomarkers can be detected and/or quantified using technologies well known to those of skill in the art such as gel electrophoresis, immunohistochemistry, and antibody binding. Methods for generating antibodies to a polypeptide of interest (e.g., an SIRT1 peptide or polypeptide, a BCL6 peptide or polypeptide, or a beta 3 peptide or polypeptide) are well known to those of ordinary skill in the art. An antibody against a protein biomarker of the presently disclosed subject matter can be any monoclonal or polyclonal antibody, so long as it suitably recognizes the protein biomarker. In some embodiments, antibodies are produced using the protein biomarker as the immunogen according to any conventional antibody or antiserum preparation process. The presently disclosed subject matter provides for the use of both monoclonal and polyclonal antibodies. In addition, a protein used herein as the immunogen is not limited to any particular type of immunogen. For example, fragments of the protein biomarkers of the presently disclosed subject matter can be used as immunogens. The fragments can be obtained by any method including, but not limited to, expressing a fragment of the gene encoding the protein, enzymatic processing of the protein, chemical synthesis, and the like. Antibodies against the instantly disclosed biomarkers can also be purchased from commercial suppliers such as, but not limited to Santa Cruz Biotechnology, Inc. (Santa Cruz, Calif., United States of America), ABCAM® (Cambridge, Mass., United States of America), Cell Signaling Technology, Inc. (Danvers, Mass., United States of America), Thermo Fisher Scientific Inc. (Rockford, Ill., United States of America), eBioscience, Inc. (San Diego, Calif., United States of America), etc. Specific primary antibodies that can be used to assay expression of SIRT1 and BCL6 are described in the EXAMPLES.

The antibodies of the presently disclosed subject matter can be useful for detecting and/or quantifying the protein biomarkers. For example, antibody binding can be detected by techniques known in the art (e.g., radioimmunoassay, ELISA (enzyme-linked immunosorbant assay), "sandwich" immunoassays, immunoradiometric assays, gel diffusion precipitation reactions, immunodiffusion assays, in situ immunoassays (e.g., using colloidal gold, enzyme or radioisotope labels, for example), Western blots, precipitation reactions, agglutination assays (e.g., gel agglutination assays, hemagglutination assays, etc.), complement fixation assays, immunofluorescence assays, protein A assays, flow cytometry, and immunoelectrophoresis assays, etc. One example of an immunoassay is described in U.S. Pat. Nos. 5,599,677 and 5,672,480, the disclosure of each of which is herein incorporated by reference. Upon review of the present disclosure, those skilled in the art will be familiar with numerous specific immunoassay formats and variations thereof that can be useful for carrying out the methods of the presently disclosed subject matter.

As such, in some embodiments the presently disclosed subject matter provides methods for detecting the presence of endometriosis, subfertility, recurrent pregnancy loss, progesterone-resistance, or any combination thereof in a subject by assaying for the presence or absence of SIRT1 alone or in combination with one or more of the presently disclosed biomarkers. In some embodiments, the presently disclosed methods comprise (a) providing a subject suspected of having endometriosis, subfertility, recurrent pregnancy loss, progesterone-resistance, or any combination thereof; (b) detecting the presence or absence of biomarker SIRT1, optionally biomarkers SIRT1 and BCL6, and further optionally biomarkers SIRT1, BCL6, and beta3, in a sample from the subject; and (c) determining the presence of endometriosis, subfertility, or both endometriosis and subfertility in the subject based on the detecting step(s).

In some embodiments of the presently disclosed subject matter, a kit is provided for measuring the presence and/or amount of one or more biomarkers in a sample of the subject. In some embodiments, the kit can comprise (i) detection molecules specific for a biomarker; and (ii) directions for measuring the presence or amount of a biomarker. In some embodiments, the kit can also include directions for using the determined biomarker levels in managing treatment. The phrase "detection molecule" is used herein in its broadest sense to include any molecule that can bind with sufficient specificity to one of the biomarkers to allow for detection of the particular biomarker in the presence or absence of the other biomarker. To allow for detection can mean to determine the presence or absence of the particular biomarker and, in some embodiments, can mean to determine the amount of the particular biomarker. Detection molecules can include antibodies, antibody fragments, and nucleic acid molecules (such as but not limited to primers for PCR approaches or probes). In some embodiments, the detection molecules comprise a conjugated detectable group. In some embodiments, the detection molecules comprise antibodies specific for each of the protein biomarkers.

Approaches for producing a detectable signal include the use of radioactive labels (e.g., $^{32}P$, $^{35}S$, $^{125}I$, $^{131}I$), enzyme labels (e.g., horseradish peroxidase, alkaline phosphatase), fluorescent labels (e.g., fluorescein, rhodamine, and fluorophores of the ALEXA-FLUOR® brand series of fluorescent dye labels available from the MOLECULAR PROBES® division of Thermo Fisher Scientific Inc., Eugene, Oreg., United States of America) and so forth, in accordance with known techniques, as will be apparent to one skilled in the art upon review of the present disclosure. Many methods are known in the art for detecting binding in an immunoassay or in a nucleic acid assay, and are within the scope of the presently disclosed subject matter.

In some embodiments, direct detection methods are provided, such as, for example, wherein the detection molecule is a primary antibody specific for a biomarker and detection is by using a label present on the primary antibody. In some embodiments, the detection molecule can be detected using an indirect method such as using a labeled secondary antibody that detects the presence of the primary antibody by binding to the primary antibody per se. For example, if the primary antibody is a mouse monoclonal antibody that is specific for a biomarker of the presently disclosed subject matter, a detectably labeled anti-mouse antibody (e.g., an anti-mouse IgG or IgM secondary antibody raised in a species other than mice) can be used to detect the presence of the primary antibody bound to the biomarker In some embodiments, the presence or absence of the biomarkers SIRT1 and BCL6, or SIRT1, BCL6, and beta3 are determined simultaneously. This can be accomplished in some embodiments by conjugating differently detectable labels to an anti-SIRT1 primary antibody, and anti-BCL6 primary antibody, and optionally also an anti-beta3 primary antibody. In some embodiments, this can be accomplished by using unlabeled primary antibodies that can be differentially detected using secondary antibodies that are conjugated to different detectable labels. In some embodiments, the presence or absence of the biomarkers SIRT1 and BCL6, and beta3 if desired, are determined sequentially, for example by detecting SIRT1 expression in one section of an endometrial biopsy, BCL6 expression in another (e.g., serial) section of an endometrial biopsy, and if desired, detecting beta3 expression in another (e.g., serial) section of the same endometrial biopsy. In some embodiments, serial sections can be assayed on separate slides or on the same slide provided that the slide contains a barrier to prevent intermixing of reagents. It is noted, however, that since upregulation of SIRT1 expression occurs throughout the menstrual cycle of affected women, SIRT1 expression and BCL6/beta3 expression can be assayed in sections of endometrial biopsies taken at different times from a subject.

Thus, the detection molecule can in some embodiments be detected using an indirect method such as by detecting binding of a specific binding partner to the detection molecule. The specific binding partner can be any molecule that binds with sufficient specificity to the detection molecule to allow for detection of the particular detection molecule in the presence or absence of the detection molecules for the other biomarker. In some embodiments, the detection molecule is a primary antibody and the primary antibody can be detected by detecting binding of a secondary antibody or a reagent or other specific binding partner to the primary antibody. For example, in some embodiments the specific binding partner can be a secondary antibody that recognizes the detection molecule that is a primary antibody. In some embodiments the specific binding partner can be a molecule that specifically binds to a group on the detection molecule such as, for example, a biotin group on the detection molecule. In some embodiments, the binding partner can be labeled. In some embodiments, the binding partner is a secondary antibody that can be labeled.

As such, indirect detection methods can in some embodiments involve a detection molecule that is an unlabeled primary antibody and a binding partner that is a labeled secondary antibody. This method can be more sensitive than direct detection methods due to signal amplification through more than one secondary antibody reaction with different antigenic sites on the primary antibody. In some embodiments, the indirect detection method is an immunofluorescence method, wherein the secondary antibody can be labeled with a fluorescent dye such as FITC, rhodamine, Texas red, or an ALEXA-FLUOR® dye. In some embodiments, the indirect detection method is an immunoenzyme method, wherein the secondary antibody can be labeled with an enzyme such as peroxidase, alkaline phosphatase, or glucose oxidase.

In some embodiments, an immunoassay can comprise antibodies specific for one or more biomarkers and an approach for producing a detectable signal. In some embodiments, the antibodies can be immobilized on a support (such as a bead, plate, or slide) in accordance with known techniques, and contacted with a test sample in liquid phase. The support can then be separated from the liquid phase and either the support phase or the liquid phase can be examined for the detectable signal that is related to the presence of the biomarker.

Accordingly, in some embodiments a sample is a tissue section and the detecting step comprises immunohistochemically staining the sample with one or more primary antibodies that bind to an SIRT1 gene product, a BCL6 gene product, or a beta3 gene product, and detecting binding of the primary antibody to the SIRT1 gene product, the BCL6 gene product, or the beta3 gene product. In some embodiments, each of the one or more primary antibodies comprises a detectable label (in some embodiments a different detectable label), and detecting binding of the individual primary antibodies to the SIRT1 gene product, the BCL6 gene product, and/or a beta3 gene product comprises detecting the [different] detectable label. In some embodiments, detecting binding of a primary antibody to the SIRT1 gene product, the BCL6 gene product, or the beta3 gene product comprises detecting a complex of the primary antibody and the SIRT1 gene product, the BCL6 gene product, or the beta3 gene product using one or more labeled secondary antibodies that are specific for the individual primary antibodies. In some embodiments, the sample to be assayed for SIRT1 gene expression, BCL6 gene expression, and/or beta3 gene expression is a cell extract and the contacting and detecting steps comprise immunoblotting with a primary antibody comprising a detectable label that is specific for the SIRT1 gene product, the BCL6 gene product, or the beta3 gene product, and detecting each individual detectable label employed; or immunoblotting with primary antibodies that are specific for the SIRT1 gene product, the BCL6 gene product, or the beta3 gene product and detecting the primary antibodies indirectly with labeled secondary antibodies that bind to the individual primary antibodies.

In some embodiments, the results of the various antibody-based assays are expressed in terms of a "histochemistry score", also known as an HSCORE. HSCOREs are expressions of antibody staining intensity, and are broadly discussed in Lessey et al., 1992. By way of example and not limitation, in some embodiments an HSCORE is calculated using the following equation:

$$HSCORE=\Sigma Pi(i+1)/100$$

where i=the intensity of staining of cells in the sample with a value of 1 being low staining, 2 being moderate staining, and 3 being strong staining, and Pi being the percentage of stained cells in the sample for each intensity, varying from 0-100%. An HSCORE can function as a pre-determined cut-off such that expression above or below a pre-determined HSCORE in a particular subject for a particular biomarker can permit that subject's status for that biomarker to be identified as "normal" vs. "abnormal", positive vs. negative, or any other discriminator. With respect to a biomarker (i.e., SIRT1, BCL6, beta3), for example, in some embodiments an abnormal SIRT1, BCL6, beta3 status comprises an HSCORE for the subject with respect to SIRT1, BCL6, beta3 gene product expression during the subject's menstrual cycle (in some embodiments during the second half of the subject's menstrual cycle) that is greater than a pre-determined cut-off value, which in some embodiments can be selected from the group consisting of 1.0, 1.1, 1.2, 1.3, 1.4, 1.5, 1.6, 1.7, 1.8, 1.9, and 2.0. In some embodiments, a pre-determined cut-off for SIRT1 expression is an HSCORE of 1.4 In some embodiments, a pre-determined cut-off for BCL6 expression is an HSCORE of 1.4. Similarly, with respect to beta3, in some embodiments an abnormal beta3 status comprises an HSCORE for the subject with respect to beta3 gene product expression during the second half of the subject's menstrual cycle that is less than a pre-determined cut-off value. In some embodiments, an HSCORE for the subject with respect to beta3 gene product expression during the second half of the subject's menstrual cycle that is less than a pre-determined cut-off value, which in some embodiments can be selected from the group consisting of 0.1, 0.2, 0.3, 0.4, 0.5, 0.6, 0.7, 0.8, 0.9, 1.0, 1.1, or 1.2. In some embodiments, a pre-determined cut-off for beta3 expression is an HSCORE of 0.7.

The presently disclosed subject matter also provides in some embodiments methods for increasing the likelihood of implantation of an embryo in a subject with decreased endometrial receptivity due to overexpression of an SIRT1 gene product during the subject's menstrual cycle, optionally in combination with overexpression of a BCL6 gene product during the second half of the subject's menstrual cycle. In these embodiments, a subject with decreased endometrial receptivity due to increased SIRT1 and optionally BCL6 expression is provided, and an effective treatment to reduce or eliminate the overexpression of the SIRT1 and/or BCL6 gene product and/or its biological consequences is administered. In some embodiments, the treatment is surgical and/or medical treatment of the resulting endometriosis. In some embodiments, the treatment comprises surgical removal of endometriosis present within the subject, optionally by laparoscopy. In some embodiments, the treatment comprises administering to the subject an effective amount of a gonadotropin-releasing hormone (GnRH) agonist, optionally Leuprorelin (INN) (also known as leuprolide acetate, sold under the trade name LUPRON® by Abbott Laboratories Corp., North Chicago, Ill., United States of America).

In some embodiments, the treatment comprises administering an effective amount of an SIRT1 inhibitor to the subject. SIRT1 inhibitors include, but are not limited to anti-SIRT1 antibodies, small molecules (see e.g., U.S. Patent Application Publication No. 2009/0022694; PCT International Patent Application Publication No. WO 2010/090830; U.S. Patent Application Publication No. 2013/0338178) such as but not limited to 1,2-dihydro-3H-naphtho[2,1-b]pyran-3-one (splitomicin; available from Sigma-Aldrich Corp., St. Louis, Mo.), cyclic lipopeptide surfactin and derivatives thereof (see e.g., Chakrabarty et al., 2008), and microRNAs, such as but not limited to those disclosed in, for example, Yamakuchi et al., 2008; Gambari et al., 2011; Xu et al., 2011), which in some embodiments can be miR-34a, miR-22, or a derivative thereof.

In some embodiments, the treatment comprises administering an effective amount of a BCL6 inhibitor to the subject, either alone or as part of a combination treatment with an SIRT1 inhibitor. Exemplary BCL6 inhibitors include small molecules (see. e.g., U.S. Pat. No. 8,338,464; U.S. Patent Application Publication No. 2012/0014979 (see e.g., compounds of Formula I described therein, particularly molecule 79-6 (2-[5-(5-bromo-2-oxo-1,2-dihydro-indole-3-ylidene)-4-oxo-2-thiazolidin-3-yl]-succinic acid)); PCT International Patent Application Publication No. WO 2014/204859); peptides and peptidomimetics, such as but not limited to the "BCL6 Peptide Inhibitors ("BPIs")" (e.g., BPI-1 (NH$_2$-G(RRRQRRKKR)GG(RGIEHAAR)GG(DIM)G(EW)G(NEIF)G(AIA)G(FL)G-OH; SEQ ID NO: 159), where the amino acids are in single letter code, and the amino acids in parentheses are the D-isomer forms of the amino acids), the peptide GRGIEHISR (SEQ ID NO: 160), and the peptide GRGIEHISRG (SEQ ID NO: 161; see U.S. Pat. No. 8,791,075); the BCL6 inhibitor peptide described in U.S. Pat. No. 8,841,414 and Polo et al., 2004); anti-BCL6 antibodies and fragments and derivatives thereof; etc.

In some embodiments, a lack of beta3 expression in the subject is also treated in the subject, for example by administering to the subject an effective amount of an aromatase inhibitor such as but not limited to Letrozole (4,4'-((1H-1,2,4-triazol-1-yl)methylene)dibenzonitrile; see Miller et al., 2012). Treatment with the aromatase inhibitor can occur before, concurrently with, or after the treatment designed to address BCL6 overexpression.

The presently disclosed subject matter also provides in some embodiments methods for assessing the effectiveness of an infertility treatment. In some embodiments, the methods comprise assessing SIRT1 expression, optionally in combination with BCL6 expression, in an infertile subject, administering a treatment designed to reduce or eliminate endometriosis in the subject, and re-assessing SIRT1 expression and/or BCL6 expression in the infertile subject subsequent to the treatment to determine of the treatment reduced SIRT1 and/or BCL6 expression in the subject. In some embodiments, SIRT1 and/or BCL6 expression is sufficiently reduced by the treatment, and transfer of an embryo to the subject can be performed. In some embodiments, SIRT1 and/or BCL6 expression is not adequately reduced in the subject, and a second treatment designed to reduce or eliminate endometriosis in the subject is administered. In some embodiments the second treatment is the same treatment as the first treatment, and in some embodiments the second treatment is a different treatment than the first treatment. In some embodiments, SIRT1 and/or BCL6 status is again assessed after the second treatment, and if SIRT1 and/or BCL6 expression is sufficiently reduced by the treatment, transfer of an embryo to the subject can be performed. In some embodiments, SIRT1 and/or BCL6 expression is still not adequately reduced in the subject, and the subject is either retreated or is deemed insufficiently receptive to embryo transfer at least at that time.

The presently disclosed subject matter includes kits for detecting each of the biomarkers. In some embodiments, the kit can comprise detection molecules, such as antibodies or nucleic acid molecules (such as but not limited to primers for PCR approaches and probes) specific for the biomarkers, the reagents necessary for producing a detectable signal as described above, and appropriate buffers. In some embodiments, the kit can contain all of the components necessary to perform a detection assay, including all controls, directions for performing assays, any necessary software for analysis of the data generated by the presently disclosed methods, and for presentation of the results. Indeed, in some embodiments the presently disclosed methods are performed and/or the kits are employed using a suitably programmed computer, in some aspects.

Detection kits for carrying out the methods of the presently disclosed subject matter can be produced in a number of ways. In some embodiments, the detection kit can comprise a detection molecule that is an antibody or antibody fragment that specifically binds to a protein biomarker as disclosed herein immobilized on a solid support, and a second antibody or antibody fragment specific for the first antibody or antibody fragment conjugated to a detectable group. In some embodiments, the kit can also include ancillary reagents such as buffering agents and protein stabilizing agents, and can include (where necessary) other members of the detectable signal-producing system of which the detectable group is a part (e.g., enzyme substrates); agents for reducing background interference in a test; control reagents; apparatus for conducting a test, and the like, as will be apparent to those skilled in the art upon a review of the instant disclosure.

In some embodiments, the detection kit can comprise antibodies or antibody fragments specific for each of the presently disclosed protein biomarkers, and a specific binding partner for each of the antibodies that is conjugated to a detectable group. Ancillary agents as described above can likewise be included. The test kit can be packaged in any suitable manner, typically with all groups in a single container along with a sheet or printed instructions for carrying out the test.

In some embodiments, the detection assay for the biomarker(s) can be automated. Methods for the automation of immunoassays include those described in U.S. Pat. Nos. 5,885,530, 4,981,785, 6,159,750, and 5,358,691, each of which is herein incorporated by reference. In some embodiments, analysis of the biomarker data in combination with assessing histomorphology and presentation of results can also be automated. In this manner, a clinician can access the test results using any suitable approach or device. Thus, in some embodiments, a clinician need not understand the raw data, as the data can be presented directly to the clinician in its most useful form. The clinician is then able to immediately utilize the information to optimize care of the subject. The presently disclosed subject matter provides any method, system, and/or apparatus capable of receiving, processing, and transmitting the information to and from laboratories conducting the assays, information providers, medical personnel, and subjects.

The presently disclosed subject matter also provides methods for modulating a SIRT1 biological activity and optionally also a BCL6 biological activity, in a subject. In some embodiments, the methods comprise administering to the subject a therapeutically effective amount of a STAT3 inhibitor. In some embodiments, the inhibitor of STAT3 biological activity is selected from the group consisting of an anti-STAT3 antibody or a paratope-containing fragment or derivative thereof, an SH2 domain inhibitor or dimerization inhibitor (SDI, site B), a DNA binding domain inhibitor (DBDI, site C); an N-terminal domain inhibitor (NDI, site D), or any combination thereof. In some embodiments, a STAT3 inhibitor is selected from the group consisting of the STAT3 inhibitors listed in Table 1 of Yue & Turkson, 2009, including but not limited to the peptides PY*LKTK (SEQ ID NO: 162; see e.g., Turkson et al., 2001; Vultur et al., 2004) and Y*LPQTV (SEQ ID NO: 163; see e.g., Ren et al., 2003; Coleman et al., 2005), where Y* indicates a phosphotyrosine. Other exemplary STAT3 inhibitors include soluble fragments of STAT3 polypeptides. The soluble fragments can be provided as fusion proteins (e.g., as IgG fusion proteins). STAT3 inhibitors can additionally include antibodies to STAT3 polypeptides, antisense molecules having a nucleotide sequence at least partially complementary to STAT3 (including but not limited to the STAT3 nucleotide sequence as set forth in Accession Nos. NM_139276, NM_003150, and NM_213662 of the GENBANK® biosequence database). STAT3 inhibitors can additionally include antibodies to STAT3 polypeptides, as well as small molecule inhibitors of STAT3 polypeptides. The small molecules can act by inhibiting the expression and/or activity of an STAT3 polypeptide. ISS 610 (see e.g., Turkson et al., 2004a), S3I-M2001 (see e.g., Siddiquee et al., 2007a), STA-21 (see e.g, Song et al., 2005; Chen et al., BMC Cancer. 2007; 7:111), S3I-201 (see e.g., Siddiquee et al., 2007b), Stattic (see e.g., Schust et al., 2006), catechol-containing compounds (see e.g., Hao et al., 2008), IS3 295 (see e.g., Turkson et al., 2005), CPA-1 and/or CPA-7 (see e.g., Turkson et al., 2004b), Galiellalactone (see e.g., Weidler et al., 2000; Hellsten et al., 2008), peptide aptamers (see e.g., Borghouts et al., 2008; Nagel-Wolfrum et al., 2004), Decoy ODN (see e.g., Leong et al., 2003; Xi et al., 2005), G-quartet ODN (see e.g., Jing et al., 2004; Jing et al., 2006; Weerasinghe et al., 2007), and peptides (see e.g., Timofeeva et al., 2007). Additional examples of STAT3 modulators include, but are not limited to, pyrimethamine, pimozide, guanabenz acetate, alprenolol hydrochloride, nifuroxazide, solanine alpha, fluoxetine hydrochloride, ifosfamide, pyrvinium pamoate, moricizine hydrochloride, 3,3'-oxybis[tetrahydrothiophene, 1,1,1',1'-tetraoxide], 3-(1,3-benzodioxol-5-yl)-1, 6-dimethyl-pyrimido[5,4-e]-1,2,4-triazine-5,7(-1H,6H)-dione, 2-(1,8-Naphthyridin-2-yl)phenol, 3-(2-hydroxyphenyl)-3-phenyl-N,N-dipropylpropanamide as well as any derivatives of these compounds or analogues thereof. In some embodiments, a STAT3 inhibitor is selected from the group consisting of the small molecules disclosed in, for example, U.S. Pat. No. 8,609,639 to Turkson et al. and U.S. Patent Application Publication No. 2015/0361031. In some embodiments, a STAT3 inhibitor is a peptide or a peptidomimetic selected from the peptides or peptidomimetics disclosed in, for example, U.S. Patent Application Publication Nos. 2009/0318367 and 2013/0177979.

EXAMPLES

The following EXAMPLES provide illustrative embodiments. Certain aspects of the following EXAMPLES are disclosed in terms of techniques and procedures found or contemplated by the present inventors to work well in the practice of the embodiments. In light of the present disclosure and the general level of skill in the art, those of skill will appreciate that the following EXAMPLES are intended to be exemplary only and that numerous changes, modifications, and alterations can be employed without departing from the scope of the presently claimed subject matter.

Example 1

Overexpression of SIRT1 in Eutopic Endometrial Tissue from Women with Endometriosis Human Endometrial Tissue Samples. Human endometrial tissue samples were collected from Michigan State University's Center for Women's Health Research Female Reproductive Tract Biorepository (Grand Rapids, Mich.), the Greenville Hospital System (Greenville, S.C.), and the University of North Carolina (Chapel Hill, N.C.). Samples were collected as previously described. Briefly, to compare protein levels in eutopic endometrium from women with and without endometriosis, endometrial biopsies were obtained from regularly cycling women between the ages of 18 and 45. The presence or absence of disease was confirmed during surgery. Women laparoscopically negative for this disease were placed into the control group, whereas women laparoscopically positive for this disease were placed in the endometriosis group. For control eutopic endometrium, 12 samples were collected from the proliferative and secretory phase (n=6 per phase) for western blot analysis and 8 samples were collected for immunohistochemistry analysis. For endometriosis eutopic endometrium, 54 samples were collected from the proliferative (n=16) and secretory (n=38) phases for western blot analysis and 20 samples were collected for immunohistochemistry analysis. Use of an intrauterine device (IUD) or hormonal therapies in the three months preceding surgery was exclusionary. Histologic dating of endometrial samples was performed by a board certified pathologist and subsequently confirmed by an experienced fertility specialist.

Baboon Endometrial Tissue Samples. Endometriosis was induced by intraperitoneal inoculation of menstrual endometrium on two consecutive menstrual cycles and harvested using laparotomy via endometriectomy from five female baboons. Laparotomies were performed at 3, 9, and 15 months post-inoculation to harvest the eutopic endometrial tissues and these endometrial tissues were used for immunohistochemistry analysis.

Western Blot Analysis. Western blot analyses were performed as previously described. Briefly, eutopic endometrial tissues were lysed with lysis buffer (150 mM NaCl, 10 mM Tris-HCl (pH 7.4), 2.5 mM EDTA, 0.125% Nonidet P-40 (vol/vol), a protease inhibitor cocktail (Roche Diagnostics Corp, Indianapolis, Ind.) and a phosphatase inhibitor cocktail (Sigma Aldrich Corp., St. Louis, Mo.). Equal amounts of total protein (20 μg) were separated by SDS-polyacrylamide gel electrophoresis and transferred to polyvinylidene difluoride membranes (Millipore Corp., Bedford, Mass.). The membranes were blocked with 0.5% Casein in phosphate buffered saline (PBS) and incubated with antibodies against SIRT1 (Catalogue No. 9475; Cell Signaling Technology, Danvers, Mass.), BCL6 (Catalogue No. 561520; BD Pharmingen, San Jose, Calif.), and Actin (Catalogue No. sc1616; Santa Cruz Biotechnology, Santa Cruz, Calif.). Immunoreactivity was visualized by autoradiography and band intensity was determined by relative densitometry using ImageJ software (available from the National Institutes of Health), and normalized against the bands obtained for actin.

Immunohistochemistry and Immunofluorescence Analyses. Immunohistochemistry and immunofluorescence analysis were performed as described. Paraffin-embedded endometrial tissues were blocked with 10% normal goat serum in PBS (pH 7.5) and then incubated with antibodies against SIRT1 (Catalogue No. 9475; Cell Signaling Technology, Danvers, Mass.), BCL6 (Catalogue No. 561520; BD Pharmingen, San Jose, Calif.) and GLI1 (Catalogue No. sc20687; Santa Cruz Biotechnology, Santa Cruz, Calif.). For immunohistochemistry, sections were incubated with secondary antibody conjugated to horseradish peroxidase (Vector Laboratories, Burlingame, Calif.). Immunoreactivity was detected using the VECTASTAIN® ELITE® brand DAB kit (DAB-Vector Laboratories, Burlingame, Calif.) and counterstained with hematoxylin. A semi-quantitative grading system (H-score) was used to compare the immunohistochemical staining intensities as described. For immunofluorescence, the sections were exposed to primary antibodies overnight at 4° C. and secondary antibodies (Alexa Fluor 488-conjugated anti-rabbit IgG; Invitrogen, Grand Island, N.Y.) and Alexa Fluor 594-conjugated anti-mouse IgG (Invitrogen) for 2 hour at room temperature. 4',6-diamidino-2-phenylindole (DAPI; Vector Laboratories) was used to enable nuclear visualization.

Immunoprecipitation Analysis. Immunoprecipitation analyses were performed as described. Protein lysates were immunoprecipitated with anti-SIRT1 antibodies (Catalogue No. 9475; Cell Signaling Technology, Danvers, Mass.) with protein A-agarose (Pierce Biotechnology, Rockford, Ill.) overnight at 4° C. Immunocomplexes were subjected to western blot analysis using anti-BCL6 antibodies (Catalogue No. 561520; BD Pharmingen, San Jose, Calif.) and anti-SIRT1 antibodies (Cell Signaling) Cell Culture and Treatment. Ishikawa cells, which are epithelial cells of human endometrial adenocarcinoma origin, were maintained in Dulbecco's Modified Eagle's Medium with F12 (Gibco, Grand Island, N.Y.) containing 10% fetal bovine serum (FBS; Gibco) and 1% penicillin streptomycin (P/S; Gibco) at 37° C. in 5% $CO_2$. Ishikawa cells were pre-treated with 10 nM estradiol (E2, Sigma-Aldrich, St. Louis, Mo.) for 1 day and restored. After 2 days, these cells were treated with E2+1 μM medroxyprogesterone acetate (MPA; Sigma-Aldrich) and then incubated for the indicated time. All experiments were performed in triplicate.

RNA Isolation and Quantitative Real-time PCR. Total RNA were isolated using the RNeasy purification kit (Qiagen, Valencia, Calif.) according to the manufacturer's instructions. Then, cDNAs were synthesized using quantitative PCR random hexamers and MMLV Reverse Transcriptase (Invitrogen Crop., Carlsbad, Calif.). The expression levels of GLI1 were measured by quantitative real-time PCR using RT-PCR Universal Master Mix reagent (Applied Biosystems, Foster City, Calif.) according to the manufacturer's instructions. mRNA quantities were normalized against the housekeeping gene, 18S RNA, using ABI rRNA control reagents.

Chromatin Immunoprecipitation (ChIP). ChIP analysis was conducted by Active Motif (Carlsbad, Calif.) using Ishikawa cells treated with vehicle or E2+MPA for 24 hours. ChIP assays were performed as described. Briefly, 100 µg of chromatin from Ishkawa cells were immunoprecipitated by 4 µg of antibodies against BCL6 (BD Pharmingen). Eluted DNA was amplified with specific primers using SYBR Green Supermix (Bio-Rad Laboratories, Inc., Hercules, Calif.). Primers used in PCR were as follows: BCL6 A (forward: 5'-GTCCTGGGGGTGCAATAAG-3' (SEQ ID NO: 153); reverse: 5'-CCCCTCACCTCCCTTCTATT-3' (SEQ ID NO: 154)), BCL6 B (forward: 5'-ACTGACCTTC-CACACCCAAG-3' (SEQ ID NO: 155); reverse: 5'-GGAG-GAAGCATGACAAGGAA-3' (SEQ ID NO: 156)), and negative control (forward: 5'-CCTATCCCACCCCTT-CACCA-3' (SEQ ID NO: 157); reverse: 5'-TAGCCTGCC-CACCTCAGGAT-3' (SEQ ID NO: 158)). The resulting signals were normalized to input activity.

Statistical Analysis. Statistical analyses were performed using the Student's t-test for data with only two groups. For data containing more than two groups, an analysis of variance (ANOVA) test was performed and analyzed by Tukey or Bonferroni test for pairwise t-test. All data are presented as means±SEM. $p<0.05$ was considered statistically significant. All statistical analyses were performed using the Instat package from GraphPad (San Diego, Calif.).

The levels of Sirtuin 1 (SIRT1) in eutopic endometrium from proliferative and secretory phase in women with and without endometriosis were examined by western blot analysis. The results are presented in FIGS. 1A and 1B.

As shown in FIGS. 1A and 1B, SIRT1 protein levels were significantly higher in the endometrium from women with endometriosis (the mean of relative band intensity ±SEM: 41.55±6.60 and 36.04±3.36, each phase) compared with controls (1.00±0.4127 and 0.32±0.16, each phase). However, SIRT1 expressions were not changed during the menstrual cycle in the control and endometriosis groups.

To determine the cell-specific expression of SIRT1, immunohistochemical analyses in endometrium from women with and without endometriosis were also performed. The results are presented in FIGS. 1C and 1D.

SIRT1 protein levels were significantly higher in endometrial epithelial cells from endometriosis patients (the mean of H-score ±SEM: 271.33±28.14) compared to controls (96.67±30.42). These results suggested that SIRT1 might play an important role in the pathogenesis of endometriosis.

SIRT1 Expression During Different Menstrual Cycle Phases. SIRT1 expression during various phases of the menstrual cycle was examined in women by immunohistochemistry. Immunohistochemical staining of SIRT1 in endometrium from women during the proliferative, early secretory, mid-secretory, and late secretory phases was observed.

Correlation Between SIRT1 and BCL6 Expression in Endometriosis. BCL6 is a transcriptional repressor involved in B cell development and oncogenesis through the recruitment of SIRT1 deacetylase. Therefore, the relationship between SIRT1 and BCL6 proteins in eutopic endometrium of endometriosis patients was investigated. The levels of SIRT1 and BCL6 were examined and compared in eutopic endometrium using Western blot analyses. For Western blot analyses, E-cadherin and vimentin were used as an epithelial and a stromal cell marker in the endometrial samples, respectively. The results are presented in FIGS. 2A and 2B.

Figure 2:
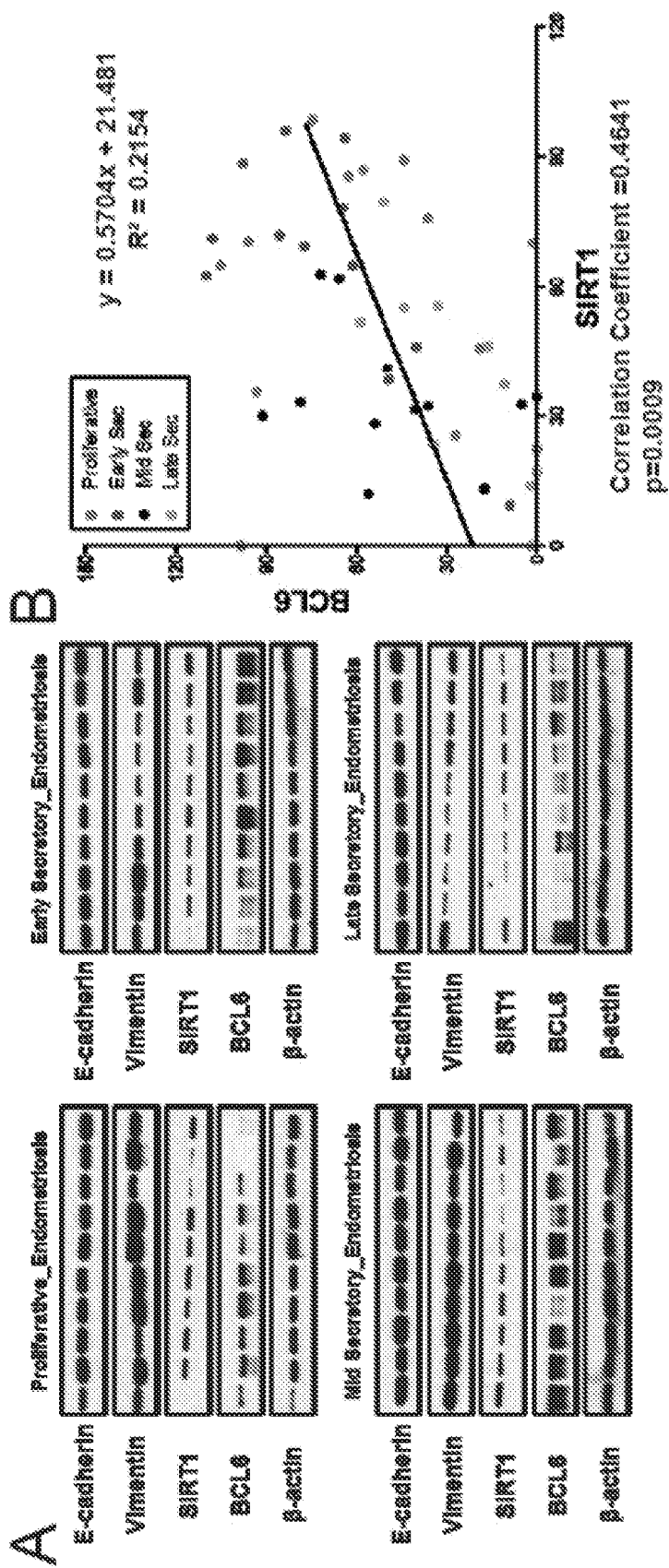
FIGS. 2A and 2B depict the results of experiments showing a correlation between SIRT1 and BCL6 in human endometrium with endometriosis.

As shown in FIGS. 2A and 2B, Western blot analyses showed that there was a strong positive correlation between SIRT1 and BCL6 levels in women with endometriosis throughout the menstrual cycle phases (correlation coefficient=0.4641; p=0.0009).

To determine whether SIRT1 proteins co-localized with BCL6 proteins with respect to endometriosis, double immunofluorescence analyses were performed for SIRT1 and BCL6. The immunofluorescence results exhibited that SIRT1 and BCL6 proteins were co-localized in endometrial epithelial cells of endometriosis patients. These results suggested that a strong correlation existed between SIRT1 and BCL6 in the endometrium, which might play an important role in the development and progression of endometriosis.

Figure 9:
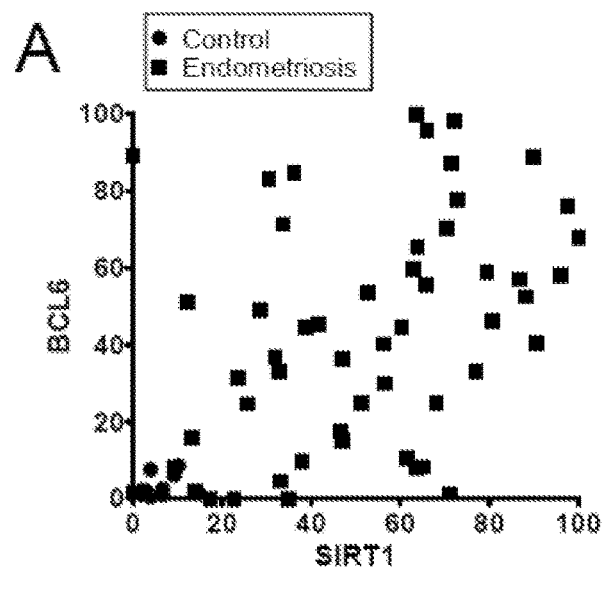
FIGS. 9A and 9B. Correlation between SIRT1 and BCL6. (A) Correlation analysis between SIRT1 and BCL6 in human endometrium with endometriosis. (B) Immunoprecipitation (IP) analysis between SIRT1 and BCL6 in Ishikawa cells and human endometrium with endometriosis. IgG: negative control.
Figure 9:
Figure 9:
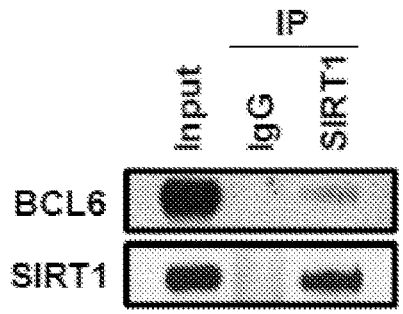
Figure 9:
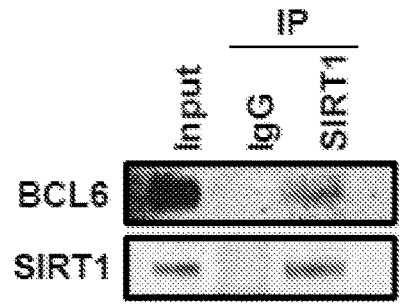

To determine whether SIRT1 physically interacts with BCL6, immunoprecipitations with SIRT1 antibody in total protein lysates from Ishikawa human endometrial adenocarcinoma cell line and endometrium from endometriosis patients were performed. The immunoprecipitation results showed that endogenous SIRT1 physically interacted with BCL6 in human endometrium (FIG. 9). However, no BCL6 was detected within the immunoprecipitate of the IgG negative control, suggesting that the SIRT1/BCL6 protein complex might play an important role in the pathogenesis of endometriosis.

Figure 10:
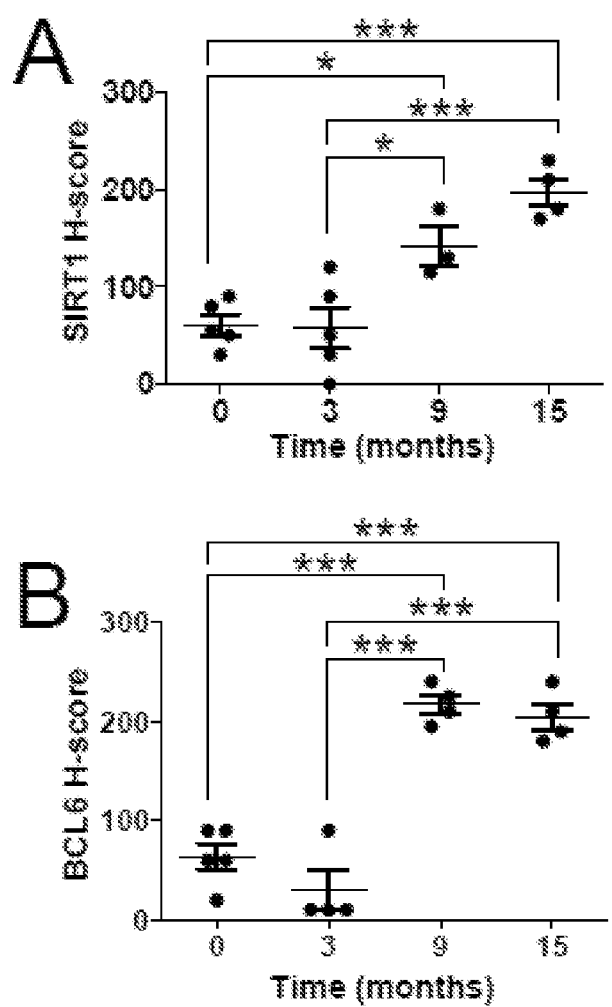
FIGS. 10A and 10B. Levels of SIRT1 and BCL6 proteins during progression of endometriosis in a baboon model. H-score of SIRT1 (A) and BCL6 (B) expression in endometriosis baboon model induced by intraperitoneal inoculation of menstrual endometrium during progression of endometriosis. The results represent the mean SEM. * $p<0.05$ and *** $p<0.001$.

Aberrant Activation of SIRT1 and BCL6 Expression During Progression of Endometriosis in a Baboon Model. Non-human primate models of endometriosis are useful for studying the temporal sequence of events involved in disease establishment and progression. To determine whether SIRT1 and BCL6 proteins are overexpressed during progression of endometriosis, immunohistochemical analyses of SIRT1 and BCL6 in the eutopic endometrium of baboons following experimental induction of the disease were performed. Expression of SIRT1 and BCL6 proteins was weakly detected in the endometrium of pre-inoculation (control) baboons. The levels of SIRT1 and BCL6 proteins were significantly increased at 9 and 15 months postinoculation during endometriosis progression (FIG. 10).

Attenuation of GLI1 Expression in Endometrium from Women with Endometriosis. SIRT1/BCL6 proteins act as a transcriptional repressor of GLI effectors of the Sonic Hedgehog pathway for neurogenesis and tumor suppression of medulloblastoma. Therefore, GLI1 levels were examined in eutopic endometrium from women with and without endometriosis by immunohistochemistry. The results are presented in FIG. 3.

Figure 3:
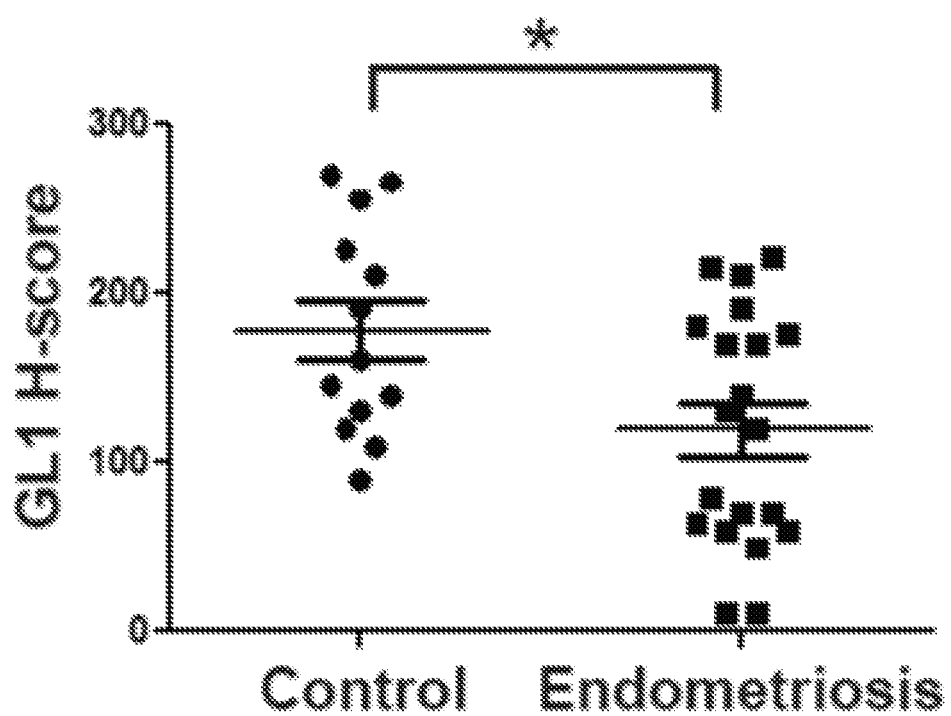
FIG. 3 depicts the results of experiments investigating levels of GLI1 in endometrium from women with (Endometriosis) and without (Control) endometriosis.

FIG. 3 is a plot of H-scores of GLI1 expression in endometrium from women with and without endometriosis. There was a significant difference (*p<0.05) in GLI1 HSCOREs between eutopic endometrium from women with (Endometriosis) and without (Control) endometriosis.

The difference in GLI1 expression between women with (Endometriosis) and without (Control) endometriosis was also confirmed by immunohistochemistry. Immunohistochemical staining of GLI1 in endometrium from women without endometriosis was visibly much higher than in endometrium from women with endometriosis.

Figure 12:
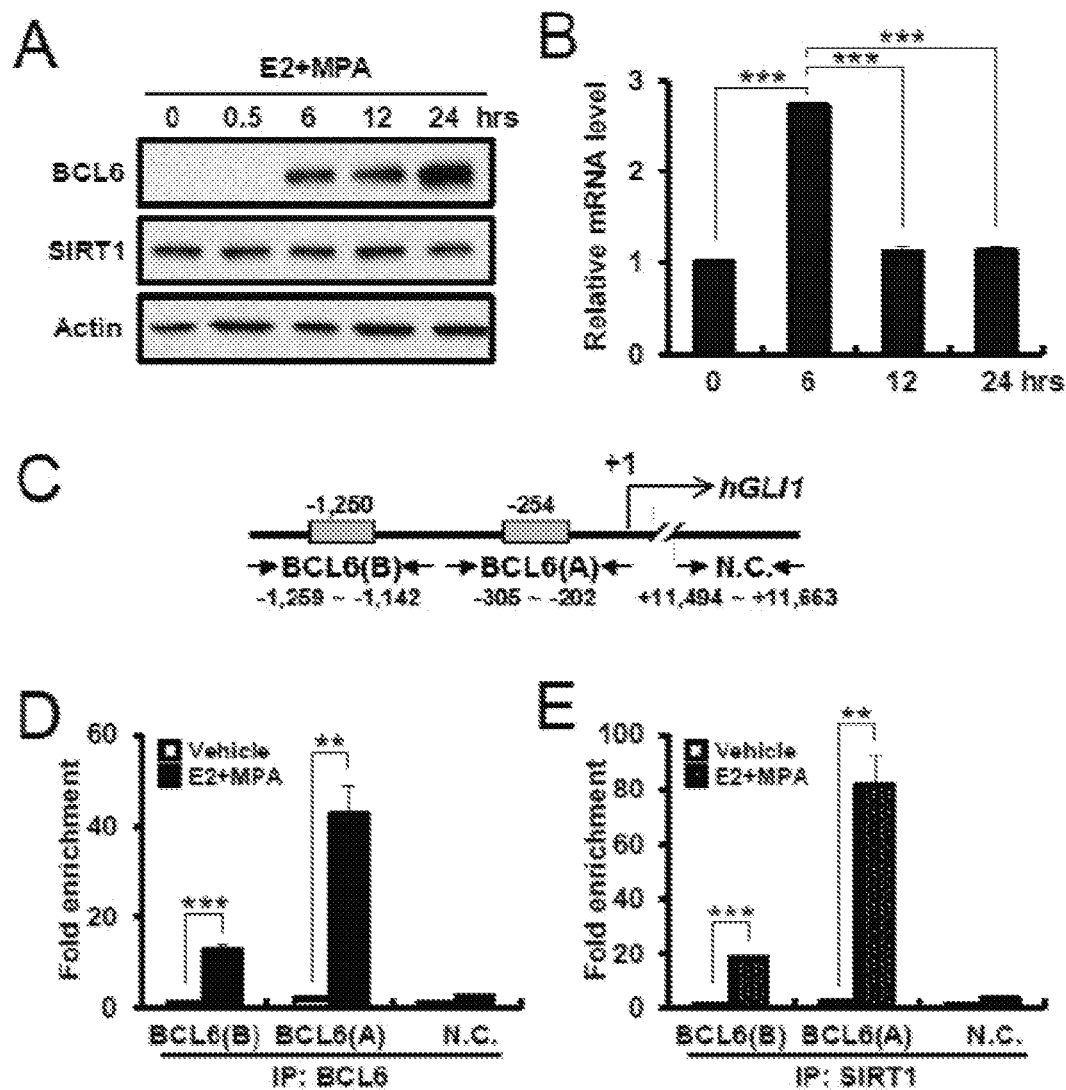
FIGS. 12A-12D. Regulation of GLI1 gene expression by SIRT1 and BCL6 proteins. (A) Western blot analysis of BCL6 and SIRT1 in Ishikawa cells treated with E2+MPA for 0, 30 min, 6, 12, and 24 hours. β-actin was used as sample-loading control. (B) Quantitative real time PCR analysis of GLI1 gene expression in Ishikawa cells treated with E2+MPA for 0, 6, 12, and 24 hours. (C) Map of BCL6 binding site on the GLI1 promoter (Gray boxes). Negative control (N.C.) region on the GLI1 gene was used as negative control of ChIP assay. Primers used in ChIP assay are presented by arrows. The numerical values below the thick back line represent nucleotide positions relative to the transcription start site for GLI1. The two gray boxes represent the −1,250 BCL6(B) binding site and the −254 BCL6 (A) binding site. (D) ChIP assay using anti-SIRT1 antibody on GLI1 promoter in Ishikawa cells treated with or without E2+MPA for 24 hours. The results represent the mean± SEM. * $p<0.05$,  $p<0.01$, and * $p<0.001$.

Transcriptional Repression of GLI1 by SIRT1 and BCL6 Proteins. To gain insight into the underlying mechanisms in endometrial epithelial cells, Ishikawa cells were treated with E2+MPA and subsequently Western blot analyses were employed to examine the expression levels of BCL6 and SIRT1. The level of BCL6 was increased gradually after 6 hours by E2+MPA (FIG. 12A). SIRT1 levels were consistently strong in Ishikawa cells. Interestingly, the expression of GLI1 was significantly decreased after 12 hours treatment with E2+MPA (FIG. 12B). These results suggested that E2+MPA induced BCL6 and then repression of GLI1 expression.

To determine whether BCL6 binds to the putative GLI1 promoter, ChIP analyses were performed on chromatin from Ishikawa cells treated with E2+MPA. The ChIP results exhibited that BCL6 (FIG. 12D) proteins and SIRT1 proteins (FIG. 12E) were significantly accumulated on two sites (BCL6(A) and (B)) of the GLI1 promoter in Ishikawa cells treated with E2+MPA compared to vehicle control (FIG. 12C). These results suggested that BCL6 regulated transcriptional repression of GLI1 expression through direct interaction with SIRT1 in endometrial epithelial cells.

Figure 4:
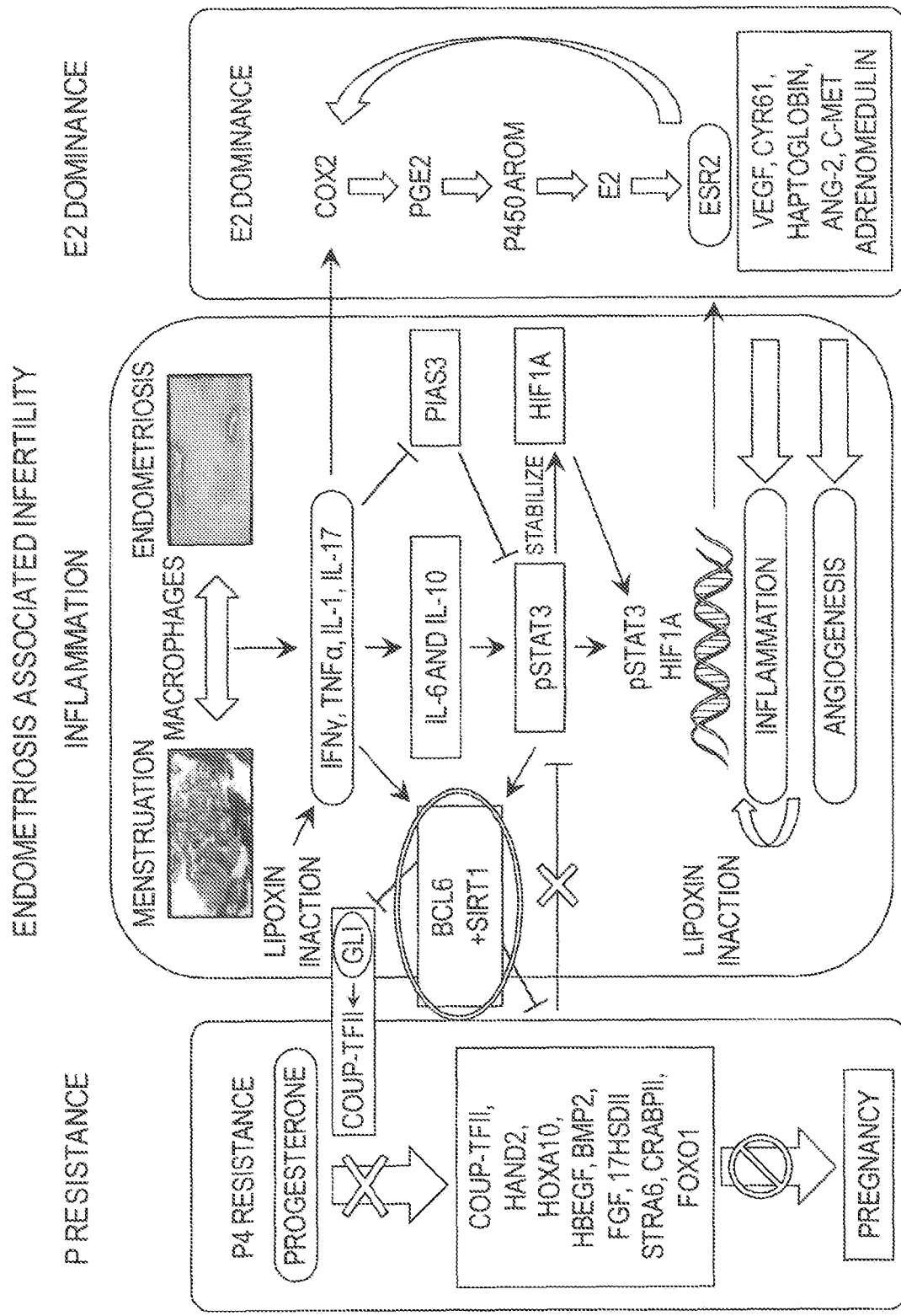
FIG. 4 is a schematic diagram showing the interactions of various gene products in P-resistance, inflammation, and E2 dominance, and particularly showing where SIRT1 and BCL6 gene products might act in these biochemical pathways.

Disclosed herein are results indicating that BCL6 and SIRT1 co-localized in the nuclei of endometrial cells from endometriosis patients. SIRT1 (a member of the sirtuin family) is a nicotinamide adenosine dinucleotide (NAD)-dependent deacetylase that is responsible for a wide variety of vital functions in the cell by removing acetyl groups from histone and non-histone proteins controlling gene expression (Pillarisetti, 2008). The number of SIRT1 substrates include many involved in endometrial function and progesterone action, including FOX01, PPARg, CTIP2 (chicken ovalbumin upstream promoter transcription factor interacting protein 2 (COUP-TFII), p300, and NF-kB (FIG. 4).

SIRT1 is known to pair with other transcription factors including BCL6. BCL6 is a transcriptional repressor involved in B cell development and oncogenesis. BCL6 has been shown to directly repress GLI1 involved in Sonic Hedgehog (SHH) signaling and recently it has been shown that BCL6 is over-expressed in eutopic endometrium of women with endometriosis. Finally, that BCL6 targeted the GLI1 promoter is disclosed herein, suggesting that together, SIRT1 and BCL6 were responsible for the reduced GLI1 expression that was observed in endometrium of women with the disease.

The concept of progesterone resistance in endometriosis is now well-established, though the underlying cause has remained elusive. As progesterone is essential for normal pregnancy, progesterone-resistance (P-resistance) is an explanation for many of the observed cellular changes in the endometrium of women with endometriosis including the failure to downregulate estrogen receptors, and altered retinoic acid signaling. As progesterone normally inhibits aromatase and inflammation, P-resistance can be implicated in escalated estrogen production via aromatase, and inflammatory changes noted in endometriosis.

Several mechanisms of cellular resistance to progesterone have been suggested, including alterations in progesterone receptor chaperone proteins FKBP52, progesterone receptor coactivator Kruppel-like factor 9 (KLF9; MIG-6, progesterone coactivator Hic-5, and direct alterations of progesterone receptor subunits. Consistent with the present disclosure, SIRT1/BCL6 might thus represent a proximal defect in endometrium of women with endometriosis that interrupts early signaling of progesterone. Progesterone initiates a complex series of paracrine signaling steps involving the Indian Hedgehog (IHH) expression by endometrial epithelium. Downstream paracrine activation of COUP-TFII occurs in the stroma, eventually acting through D-HAND and bFGF to feedback on the epithelial cell to down-regulate estrogen receptor. GLI1 has been shown to play an integral role in this pathway.

Disclosed herein are experiments that demonstrated an upregulation of SIRT1 in women with endometriosis compared to controls by western blot and immunohistochemistry, with good correlation to elevated BCL6 expression. Co-localization using immunofluorescence and co-immunoprecipitation confirmed the direct interaction of SIRT1 with BCL6 in the nucleus of affected individuals. Perhaps most striking was the concurrent upregulation of both proteins in a baboon model of endometriosis, both BCL6 and SIRT1 appearing within 9 months of induction of the disease. Animal models are useful for studying the temporal sequence of events involved in disease establishment and progression. Intraperitoneal inoculation with autologous menstrual blood results in formation of endometriotic lesions with histological and morphological characteristics similar to those seen in humans. Together, these data support an inflammatory-driven phenomenon. Interestingly, BCL6 per se appears to be regulated by different pathways.

BCL6 is induced by IL-6 via activation of STAT3. As in breast cancer, STAT5 and STAT3 appear to be reciprocally active in the endometrium. Progesterone activates endometrial STAT5. In P-resistance, the normally repressive effect of STAT5 on BCL6 might be reduced, while the activation of STAT3 seen in endometriosis likely drives BCL6 overexpression. SIRT1, on the other hand, is regulated by other factors. Estrogen has been shown to increase SIRT1, as well as inflammation-driven miRNAs. miRNA34 has been shown to inhibit SIRT1. miRNA34 levels are reduced in women with endometriosis, and this microRNA has been shown to be reduced by inflammation.

Figure 5:
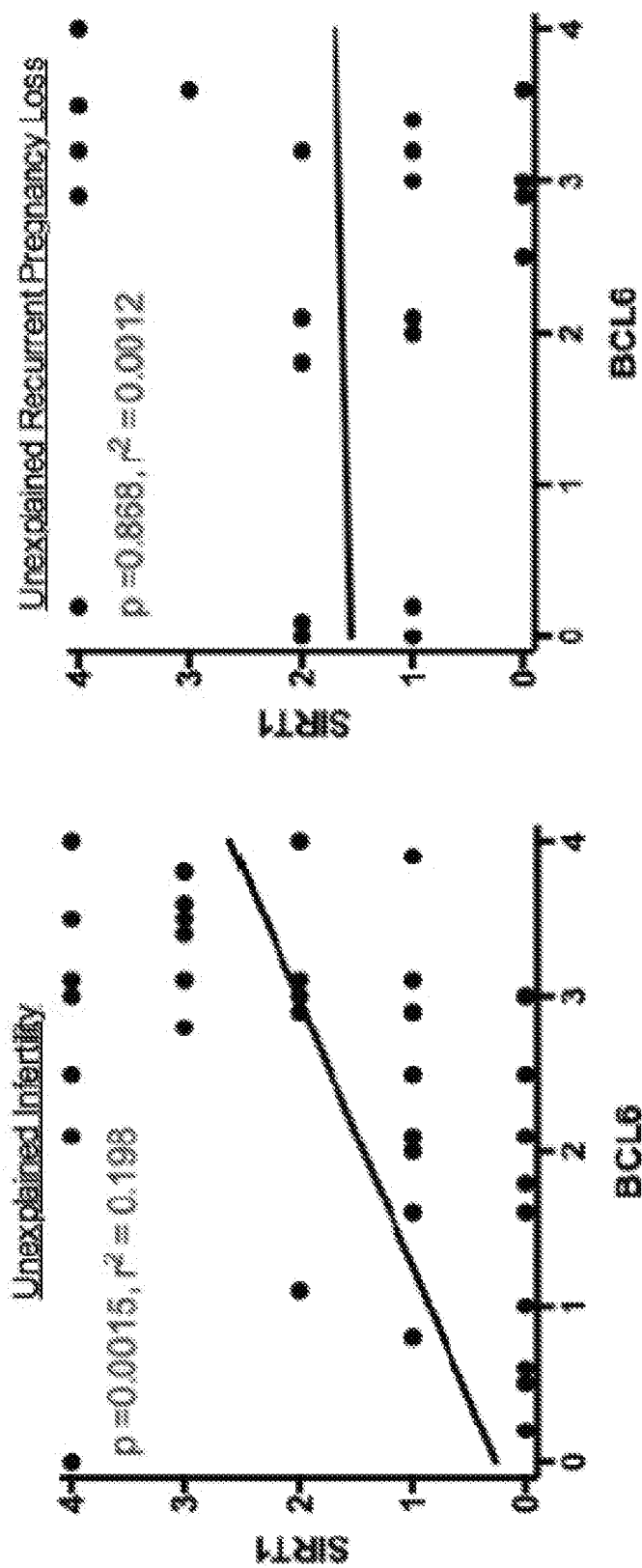
FIG. 5 is a pair of plots showing that in unexplained infertility (UI), a significant correlation was identified between SIRT1 gene expression and BCL6 gene expression. However, only about 20% of the SIRT1 staining differences observed could be explained by changes in BCL6 expression by HSCORE (see the left panel). In unexplained recurrent pregnancy loss, however (right panel), no such correlation was observed. These observations supported the observed association between SIRT1 and BCL6 and the failure to conceive.

The BCL6/BCoR/SIRT1 complex suppresses growth of human medulloblastoma cells through GLI1 and GLI2 repression. Two SIRT1 and BCL6 binding sites were identified at the proximal promoter region of GLI1 gene. The ChIP results on chromatin prepared from Ishikawa epithelial cell line disclosed herein revealed that BCL6 was enriched at the same BCL6 binding site of the GLI1promoters. BCL6/SIRT1 could thus influence chromatin acetylation patterns at the GLI1regulatory regions. The chromatin around the GLI1promoters could be remodeled in a BCL6/SIRT1-dependent manner. BCL6 acts through the recruitment of BCoR corepressor and SIRT1 histone deacetylase, thereby leading to epigenetic repression of GLI1. See also FIG. 5.

In summary, disclosed herein are experiments showing that SIRT1 was highly expressed in the endometrium of patients with endometriosis. SIRT1 relies on direct transcriptional repression of GLI1 through recruitment of BCL6. The studies disclosed herein identified a mechanism contributing to the pathogenesis of endometriosis. Progress in understanding of the etiology and pathophysiology of endometriosis and potential therapeutic interventions by targeted pharmacological agents has been hampered due, in part, to the lack of defined molecular mechanisms. However, the instant disclosure facilitates the development of new therapies against the pain and infertility of endometriosis.

Example 2

KRAS Activation and Over-Expression of SIRT1/BCL6 Contributes to the Pathogenesis of Endometriosis and Progesterone Resistance Endometriosis in an inflammatory condition that is associated with progesterone resistance and cell proliferation, resulting in pain, infertility and pregnancy loss. We previously demonstrated phosphorylation of STAT3 (pSTAT3) in eutopic endometrium of infertile women with this disorder leading to over-expression of the oncogene BCL6 and stabilization of hypoxia-induced factor 1 alpha (HIF-1α). Here we report coordinated activation of KRAS and overexpression of Sirtuin 1 (SIRT1), a histone deacetylase and gene silencer, in the endometrium from women with endometriosis throughout the menstrual cycle. The mice with conditional activation of KRAS in the PGR positive cells reveal an increase of SIRT1 expression in the endometrium compared to control mice. The expression of progesterone receptor target genes including the Indian Hedgehog pathway genes are significantly down-regulated in the mutant mice. SIRT1 co-localizes with BCL6 in the nuclei of affected individuals and both proteins bind to and suppress the promoter of GLI1, a critical mediator of progesterone action in the Indian Hedgehog pathway, by ChIP analysis. GLI1 expression is reduced in the endometrium of women with endometriosis. Together, these data suggest that KRAS, SIRT1 and BCL6 are coordinately over-expressed in eutopic endometrium of women with endometriosis and likely participate in the pathogenesis of endometriosis.

Endometriosis is a gynecologic disorder defined by the presence of endometrial cells outside of the uterine cavity. Endometriosis adds significantly to health care costs, upwards of $22 billion dollars per year in the US. Symptoms of endometriosis vary widely and include dysmenorrhea, dyspareunia, noncyclic chronic pelvic pain, and infertility, with a considerable negative impact on quality of life. Endometriosis is a major cause of infertility and pelvic pain. It affects about 5% of reproductive-age women and up to 50% of these are infertile. Surgical removal of ectopic lesions and/or hormonal suppression focused on reducing estrogen, such as progestins, androgens, gonadotropin-releasing hormone (GnRH) agonists, and aromatase inhibitors are the current gold standards of therapy. However, both approaches are associated with various side effects and a high incidence of relapse. Therefore, identification of mechanisms involved in the pathogenesis of endometriosis and strategic therapies for treatment remain critical.

The eutopic endometrium of women with endometriosis exhibits inflammation, aberrant estrogen activity, cellular proliferation and a resistance to progesterone (P4). The biological mechanisms linking endometriotic lesions to these endometrial alterations remain uncertain and controversial. P resistance and estrogen dominance likely contribute to the pathophysiology and survival of ectopic lesion and contribute to infertility as well.

KRAS has been proposed as a strong candidate gene in the pathophysiology of endometriosis. Activation of KRAS in mice was associated with endometriosis-like lesions on the peritoneum and ovaries and lesions derived from mice with activated KRAS mutation survived longer in wild type mice. While there is no direct link between KRAS mutations and the risk for endometriosis in humans, inflammation associated events including changes in miRNA expression in endometriosis, may play a role in its activation. miRNA34b was shown to be dramatically decreased in eutopic endometrium of women with endometriosis. This miRNA has been shown to have benefit in KRAS induced mouse models of other carcinomas and both let-7b and miRNA 34 have been shown to target KRAS, and both miR34 and p53 can act synergistically to suppress tumor growth.

BCL6 (B Cell Lymphoma 6) is a transcriptional gene repressor and is necessary for B cell development and oncogenesis. BCL6 has six Krüppel-type zinc finger domains and a BTB/POZ (bric-á-brac, tramtrack, broad complex/pox virus zinc finger) domain, which can bind to transcriptional factors, including Interferon Regulatory Factor (IRF) 4, BCL6-associated zinc finger (BAZF). BCL6 is one of the human proto-oncogenes and is associated with an increase in cell proliferation through the repression of genes such as p53 and p300. BCL6 DNA binding site (TTCCT (A/C)GAA) is similar with Signal Transduction and Activators of Transcription (STAT) factors and BCL6 can repress transcription via STAT factor binding sites and thus inhibit cytokine-induced transcription. Furthermore, BCL6 is up-regulated by STAT 3. STAT3 signaling is aberrantly activated in eutopic endometrium from women with endometriosis compared to those without this disease and recently, we reported that BCL6 is highly over-expressed in endometrium from women with endometriosis during the secretory phase of the menstrual cycle compared to women without endometriosis.

SIRT1 is a member of the sirtuin family of proteins and homologs to the yeast Sir2 protein. Sirtuin family proteins are Class III HDACs. SIRT1 can deacetylate both histones and non-histone proteins such as p53. Its deacetylation activity enables it to regulate gene transcription and implicates in the influence of a variety of cellular processes such as aging, apoptosis, inflammation, stress resistance, and metabolism. SIRT1 has a dual role as oncogenic function as well as tumor suppressor. According to previous reports, SIRT1 plays a role as a tumor promoter in endometrial cancer by targeting sterol regulatory element binding protein 1 (SREBP1) and lipogenesis. Additionally, SIRT1 has an important role in the regulation of inflammatory cytokines expression in endometriotic stromal cells and SIRT1 has been associated with poor prognosis ovarian cancers. However, the role of SIRT1 in endometriosis and uterine biology has not been examined.

In this study, we investigated the levels of KRAS and SIRT1 proteins in endometrium from women with and without endometriosis. The levels of SIRT1 and KRAS were compared in endometrium of women with and without endometriosis. Using a mouse model, we investigated the potential link between KRAS activation and SIRT1 expression. We report here for the first time in endometrium, a direct protein-protein interaction between SIRT1 and BCL6 in human endometrial tissue, co-localizing in the nuclei of endometriosis cases. Further, we show that GLI1, a promoter target for both BCL6 and SIRT1, is reduced in eutopic endometrium of women with this disease. Based on these results, we suggest that aberrant overexpression of SIRT1 is driven by KRAS activation, and co-localizes with BCL6 contributing to the phenomenon of progesterone resistance through gene inactivation of the GLI1 promoter.

Figure 6:
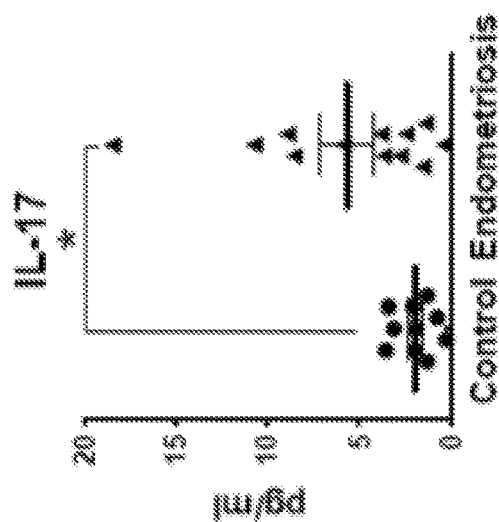
FIG. 6. Endometriosis is associated with elevated serum inflammatory cytokines including IL-1, IL-6 and IL-17, compared to normal controls.
Figure 6:
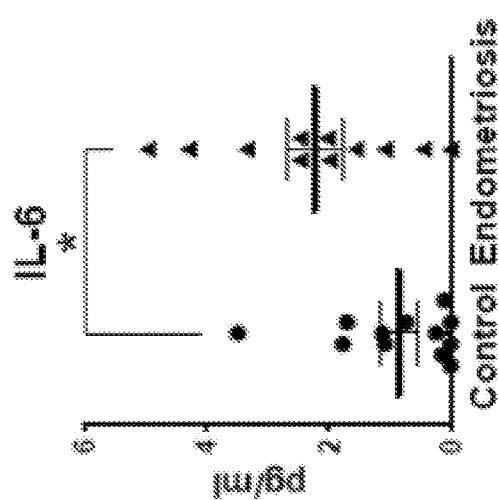
Figure 6:
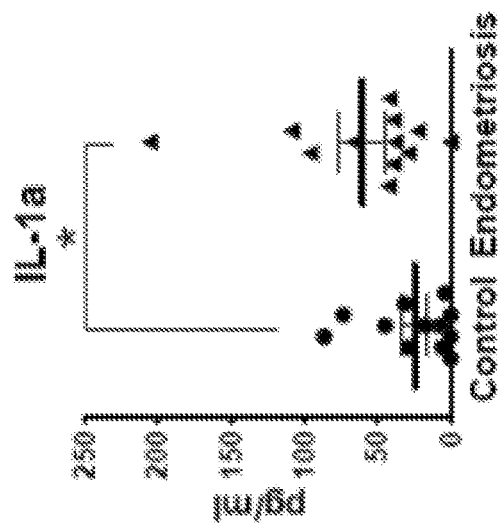

Endometriosis and Inflammation. Endometriosis is the presence of glands and stroma outside the uterus. It is often found on the ovary and peritoneum. Inflammation plays an important role in the pathogenesis of endometriosis. To further establish whether endometriosis patients exhibit systemic inflammation, we measured several known inflammatory cytokines in plasma of women with and without endometriosis. Our results revealed significant elevations in IL-1b, IL-6 and IL-17, among others (FIG. 6).

Figure 7:
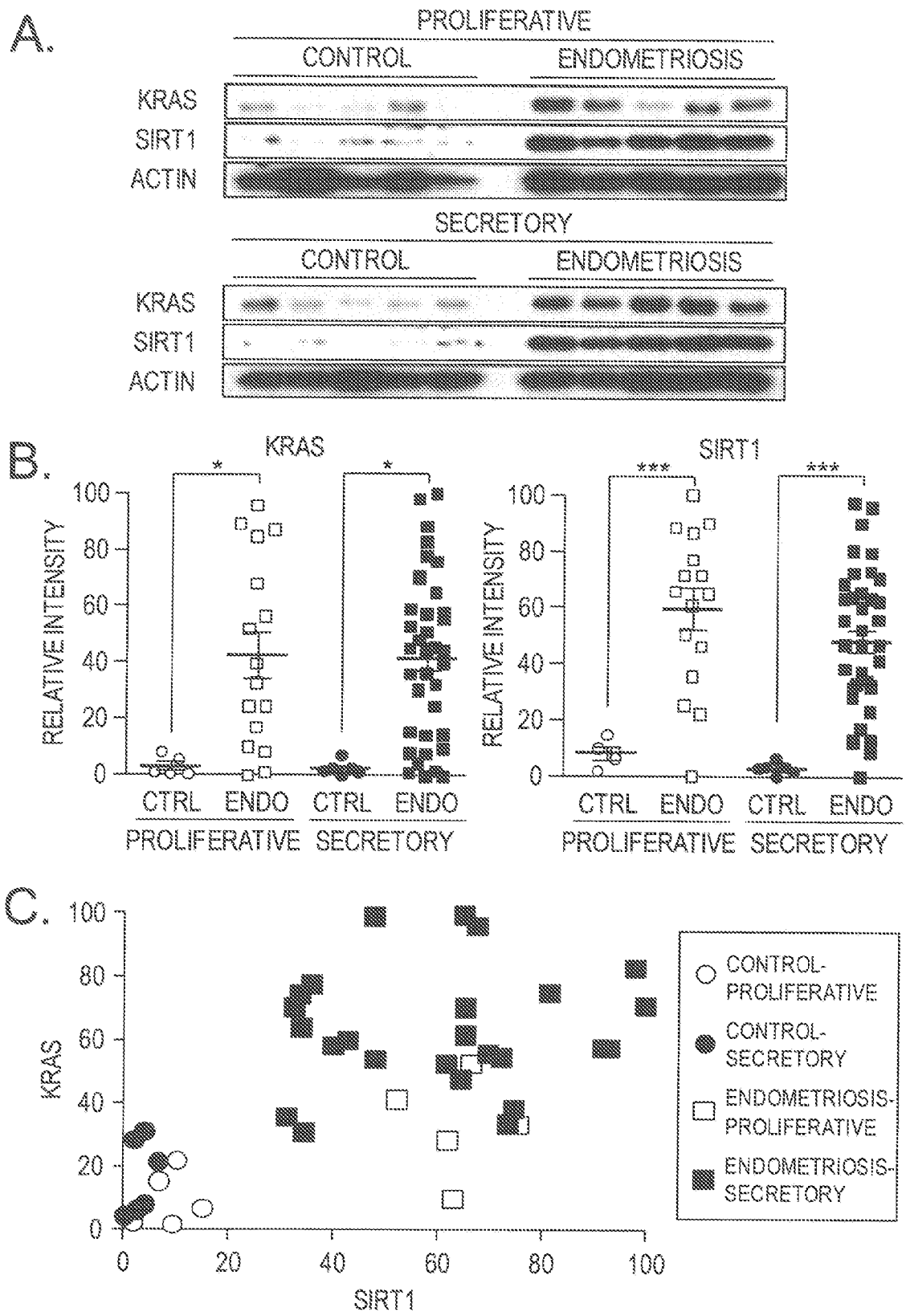
FIGS. 7A-7C. Correlation between KRAS and SIRT1 in human endometrium with endometriosis. (A) Western blot analysis of SIRT1 and BCL6 proteins in proliferative and secretory phases of human endometrium with endometriosis. β-actin was used as sample-loading control. (B) Densitometric analysis of KRAS and SIRT1 protein levels by Western blot analysis in eutopic endometrium from proliferative and secretory phase in women with and without endometriosis. (C) Correlation between SIRT1 and KRAS in women with endometriosis throughout the menstrual cycle phases based on Western blot analysis (correlation coefficient=0.4641, $p=0.0009$).

Overexpression of KRAS and SIRT1 in eutopic endometrial tissue from women with endometriosis. IL-6 activates JAK kinases and Ras-mediated signaling. Activation of mutated KRAS, the key regulator of Ras/ERK pathway, in the endometrium of mice resulted endometriosis formation. To determine whether KRAS is dysregulated in endometriosis, we first examined the expression of KRAS in endometrium from patients with and without endometriosis using Western blot. The expression levels of KRAS did not differ between proliferative (n=21) and secretory phase (n=44) in endometrium from women with and without endometriosis. However, the levels of KRAS were significantly higher in the endometrium derived from women with endometriosis (n=54) as compared to controls (n=11) (FIGS. 7A and B).

Activation of KRAS is tightly regulated by enzyme activity of SIRT1. Ras/ERK pathway also regulates SIRT11 transcription. To better understand the finding of increased KRAS in the endometrium of women with endometriosis, we investigated the association between KRAS activation and SIRT1 expression. The levels of SIRT1 protein were significantly higher in the endometrium from women with endometriosis (n=54) compared with controls (n=11) (FIGS. 2A and B). However, SIRT1 expression was low and unchanged during the menstrual cycle in the control group. FIG. 2C shows the correlation between KRAS and SIRT1 proteins in both women without and with endometriosis. There was a significant positive correlation between KRAS and SIRT1 in the endometrium of the control and endometriosis group (Spearman correlation coefficient r=0.6155, p<0.0001).

Figure 8:
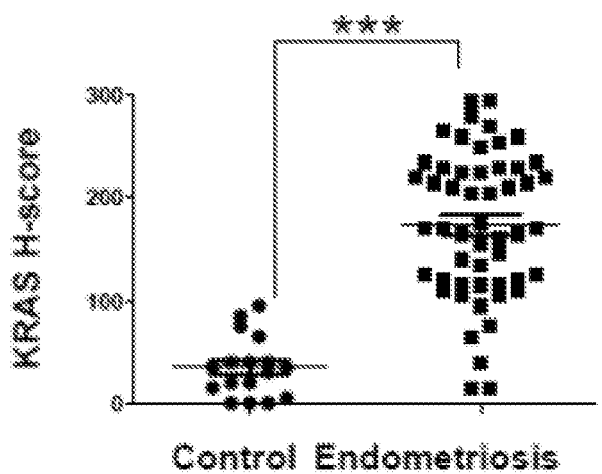
FIGS. 8A and 8B. Expression of KRAS and SIRT1 in endometrium from women with and without endometriosis. H-score of KRAS (A) and SIRT1 (B) expression in endometrium from women with and without endometriosis. The results represent the mean±SEM. *** $p<0.001$.
Figure 8:
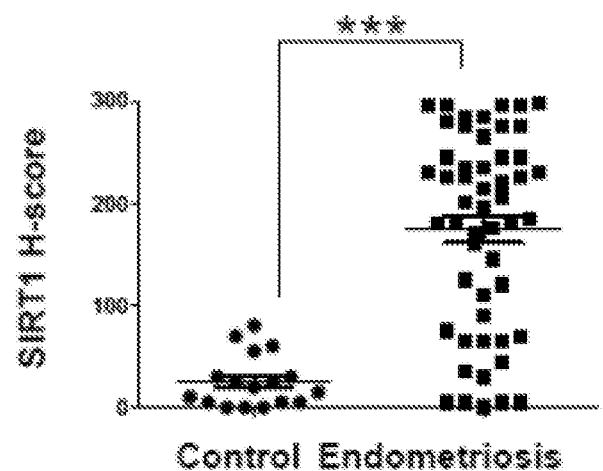
Figure 13:
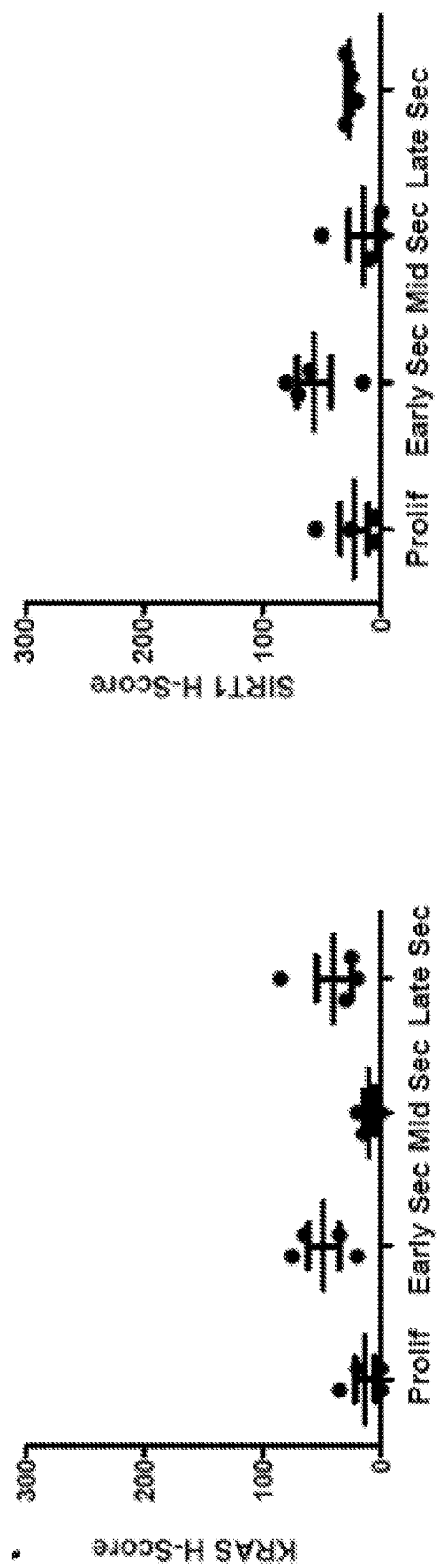
FIG. 13. Immunohistochemical analysis of KRAS and SIRT1 proteins in the endometrium during menstrual cycle in control women. KRAS and SIRT1 proteins were examined in the proliferative phase, and in the early, mid and late secretory phase of the menstrual cycle.

To determine the cell-specific expression of KRAS and SIRT1, we performed immunohistochemical analysis in endometrium from women with and without endometriosis (FIG. 8). In control women KRAS and SIRT1 proteins were weakly detected in the stromal and epithelial cells of endometrium from the proliferative phase and early, mid, and late secretory phases in women without endometriosis (n≥4 per phase) (FIG. 13). Interestingly, the levels of KRAS protein were significantly increased in the stromal and epithelial cells of endometrium from proliferative and secretory phase endometriosis patients (n=52) as compared to control patients (n=17) (FIG. 8A). The levels of SIRT1 were also significantly lower in both the stromal and epithelial cells of endometriosis patients compared to women without endometriosis (FIG. 8B). These results suggest that aberrant activation of KRAS and SIRT1 may play an important role in the pathogenesis of endometriosis and potentially serve as a specific biomarker for the presence of disease.

Correlation between SIRT1 and BCL6 in endometriosis. BCL6 is a transcriptional repressor involved in B cell development and oncogenesis and known to be involved in the recruitment of SIRT1 deacetylase. Since both proteins appear to be elevated, we analyzed the relationship between SIRT1 and BCL6 proteins in eutopic endometrium of endometriosis patients. The levels of SIRT1 and BCL6 were examined and compared in eutopic endometrium using Western blot analysis. Our results showed a strong positive correlation between SIRT1 and BCL6 levels in women with endometriosis throughout the menstrual cycle phases (n=44) (FIG. 9A). Based on the Western blot band intensity, we show a scattergram with a correlation coefficient=0.5659, p<0.0001, between BCL6 and SIRT1 expression.

To determine whether SIRT1 proteins co-localize with BCL6 proteins, we performed double immunofluorescence for SIRT1 and BCL6. The immunofluorescence results show that SIRT1 and BCL6 proteins were co-localized in endometrial epithelial cells of endometriosis patients. These results suggest a strong correlation exists between SIRT1 and BCL6 in the endometrium that may play an important role in the development and progression of endometriosis. To determine whether SIRT1 physically interacts with BCL6, we performed immunoprecipitation with SIRT1 antibody in total protein lysates from Ishikawa human endometrial adenocarcinoma cell line and endometrium from endometriosis patients. The immunoprecipitation result showed that endogenous SIRT1 physically interacts with BCL6 in human endometrium (FIG. 9B). However, no BCL6 was detected within the immune-precipitate of the IgG negative control. These results suggest that SIRT1/BCL6 protein complex may play an important role in the pathogenesis of endometriosis.

Aberrant activation of SIRT1 and BCL6 expression during progression of endometriosis in a baboon model. Non-human primate models of endometriosis are useful for studying the temporal sequence of events involved in disease establishment and progression. To determine that SIRT1 and BCL6 proteins are overexpressed as part of endometriosis development, we performed immunohistochemical analysis of SIRT1 and BCL6 in the eutopic endometrium of baboons following experimental induction of the disease (n=4 per time point). As in human endometrium, the expression of SIRT1 and BCL6 proteins were weakly detected in the endometrium of pre-inoculation (control) baboons. The levels of SIRT1 and BCL6 proteins were significantly increased at 9 and 15 months post-inoculation during endometriosis progression (FIG. 10). These data suggest that the ontogeny of BCL6 and SIRT1 expression occur synchronously, and that they require time after initiation of endometriosis to develop. The timing of the appearance of SIRT1 and BCL6 corresponds to the increase in inflammation seen in this model.

Figure 11:
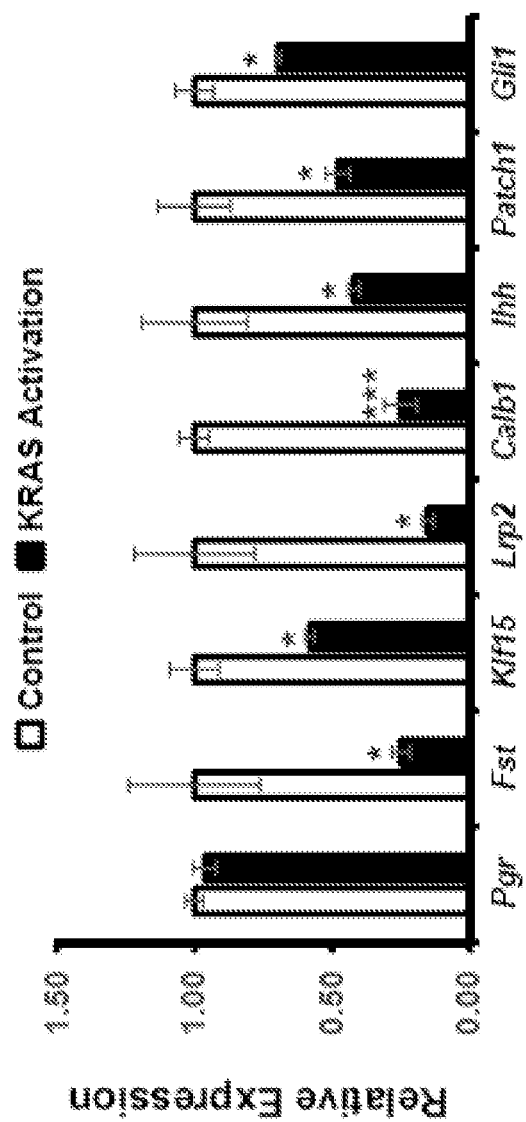
FIG. 11. Levels of SIRT1 in the KRAS activation mouse model. The mRNA expression level of P4 target genes in the uterus from control and KRAS activation mice (n=9). The results represent the mean±SEM. * $p<0.05$ and *** $p<0.001$.

SIRT1 overexpression and dysregulation of PGR target genes in mice with uterine specific KRAS activation. In order to effectively investigate the effects of the KRAS signaling pathways in endometrium, mice with loxP-Stop-loxP-Kras$^{G12D/+}$(LSL-K-ras$^{G12D/+}$) were bred to the PGR$^{Cre}$ mouse. Introduction of the oncogenic K-ras mutation in all PR-positive cells did not show any pathological phenotype in the uterus. We investigated whether KRAS activation altered the expression of SIRT in the mouse uterus using immunohistochemistry (n=3 per group). Interestingly, SIRT expression was highly increased in endometrium of the mutant mice compared to control mice. We performed real-time RT-PCR to assess the expression of PGR and its target genes in the mutant mice. Pgr expression was not changed in the mutant mice. The mRNA expression level of P4 target genes, Fst, Klf15, Lrp2, and Calb1, were highly downregulated in the mutant mice compared to the control mice. Interestingly, the expression of Ihh, Patch1, and Gli1 which are known as P4-target and Indian Hedgehog pathway genes were significantly downregulated in the mutant mice (FIG. 11). These results suggest that KRAS suppresses transcriptional activity of PGR by regulating SIRT1 expression.

Transcriptional Repression of GLI1 by SIRT1 and BCL6 proteins. To gain insight into the underlying mechanisms of SIRT1/BCL6 action in endometrial epithelial cells, we treated Ishikawa cells with E2+ MPA and subsequently used Western blot analysis to examine the expression levels of BCL6 and SIRT1. The level of BCL6 was increased gradually after 6 hours by E2+MPA (FIG. 12A). SIRT1 levels were consistently strong in Ishikawa cells. Interestingly, the expression of GLI1 was significantly decreased after 12 hours treated with E2+MPA (FIG. 12B). These results suggest that E2+MPA, a known inducer of BCL6, results in repression of GLI1 expression.

To determine that BCL6 and SIRT1 bind to the putative GLI1 promoter, we performed ChIP analysis on chromatin from Ishikawa cells treated with E2+MPA. Our ChIP results exhibited that both BCL6 and SIRT1 proteins were significantly accumulated on two sites (BCL6 (A) and (B)) of GLI1 promoter in Ishikawa cells treated with E2+MPA compared to vehicle control. Interestingly, the accumulated SIRT1 protein closely parallels what BCL6 protein accumulated on GLI1 promoter (FIGS. 12C-D). These results suggest that BCL6 regulates transcriptional repression of GLI1 expression through direct interaction with SIRT1 in endometrial epithelial cells. Further, elevated levels of SIRT1 and BCL6 in secretory phase endometrium of women with endometriosis likely accounts for the decrease noted in GLI1 protein expression, as a sign of progesterone resistance.

Attenuation of GLI1 expression in endometrium from women with endometriosis. SIRT1/BCL6 proteins act as a transcriptional repressor of GLI effectors in the Hedgehog pathway for neurogenesis and tumor suppression of medulloblastoma. Therefore, we examined GLI1 levels in eutopic endometrium from women with (n=20) and without (n=13) endometriosis by immunohistochemistry. Our immunohistochemistry analysis showed that GLI1 protein levels are significantly reduced in the endometrial epithelium of patients with endometriosis as compared to the patients without endometriosis.

KRAS, a well characterized oncogene, has been implicated in the pathogenesis of endometriosis. While mutational changes to KRAS appears to be a pivotal change in endometriosis-related ovarian cancers[36], we demonstrate for the first time, that KRAS activation is a common finding and a key biomarker in the endometrium of most women with endometriosis. We show that its activation is highly correlated to the over-expression of SIRT1 (member of the sirtuin family) and contributes to the upregulation of this histone deacetylase. Further, we postulate that inflammatory changes associated with endometriosis provide the milieu for activation of KRAS mediated BCL6/SIRT1 complexes that participate in the early stages of progesterone resistance, which contributes to infertility and a key to the pathophysiology of endometriosis growth and pathogenesis.

In the present study, we report that BCL6 and SIRT1 are over-expressed and co-localize in the nuclei of endometrial cells from women with endometriosis. SIRT1 is a nicotinamide adenosine dinucleotide (NAD)-dependent deacetylase that is responsible for a wide variety of vital functions in the cell by removing acetyl groups from histone and non-histone proteins controlling gene expression. While the regulatory controls for endometrial SIRT1 remain unknown, BCL6 is up-regulated by inflammatory stimuli including IL-6 and STAT3 activation, that we recently examined. The number of known SIRT1 targets are many and include genes involved in endometrial function and progesterone action, including GLI1, FOX01, PPARγ, CTIP2 (chicken ovalbumin upstream promoter transcription factor interacting protein 2 (COUP-TFII), and p300.

SIRT1 has been shown to pair with other transcription factors including BCL6. BCL6 is a transcriptional repressor involved in B cell development and oncogenesis. We showed that BCL6 is over-expressed in eutopic endometrium of women with endometriosis. We report for the first time that BCL6 and SIRT1 interacting through the IHH pathway both bind to and inactivate the GLI1 promoter. Collectively, these data suggest that BCL6/SIRT1 could influence chromatin acetylation patterns at the GLI1 regulatory regions and thereby contribute to epigenetic repression of GLI1. Identification of these BCL6/SIRT1-recruiting factors and the mechanism of protein-protein interaction will be of importance in future investigations.

The concept of progesterone resistance in endometriosis is now well-established, though the underlying mechanism has remained elusive. As progesterone is essential for normal pregnancy, resistance to the action of progesterone is an explanation for many of the observed cellular changes in the endometrium of women with endometriosis including the failure to down-regulate estrogen receptors, reduction in estrogen metabolism, and altered retinoic acid signaling. As progesterone normally inhibits aromatase and inflammation, progesterone resistance is implicated in aberrant estrogen production via aromatase expression, and inflammatory changes noted in endometriosis.

Several mechanisms of cellular resistance to progesterone (P) have been suggested including alterations in progesterone receptor chaperone proteins FKBP52, progesterone receptor coactivator Kruppel-like factor 9 (KLF9), MIG-6 alterations, progesterone coactivator Hic-5, and direct alterations of PR subunits. SIRT1/BCL6 represent a more proximal defect in endometrium of women with endometriosis that interferes with early signaling of progesterone. As recently reviewed, progesterone initiates a complex series of paracrine signaling steps involving the Indian Hedgehog (IHH) expression by endometrial epithelium. Down-stream paracrine activation of COUP-TFII occurs in the stroma, eventually acting through D-HAND and basic fibroblast growth factor (bFGF) to negatively feedback on the epithelial cell to down-regulate estrogen receptor. GLI1 has been shown to play an integral role in this pathway.

In this study, we demonstrated for the first time that SIRT1 is over-expressed in women with endometriosis compared to controls by western blot and immunohistochemistry, correlating directly with elevated BCL6 expression. Co-localization using immunofluorescence and co-immunoprecipitation confirmed direct interaction of SIRT1 with BCL6 in the nucleus of affected individuals. Perhaps most striking was the concurrent up-regulation of both proteins in a baboon model of endometriosis, both BCL6 and SIRT1 appearing within 9 months of induction of the disease. Animal models are useful for studying the temporal sequence of events involved in disease establishment and progression. Intraperitoneal inoculation with autologous menstrual blood results in formation of endometriotic lesions with histological and morphological characteristics similar to those seen in women. Together, these data support an inflammatory-driven phenomenon. Interestingly, BCL6 appear to be regulated by different pathways.

BCL6 is induced by IL-6 via activation of STAT3. As in breast cancer, STAT5 and STAT3 appear to be reciprocally active in the endometrium. Progesterone activates endometrial STAT5. We show that IL-6 and other inflammatory mediators are higher in women with endometriosis. In progesterone resistance, the normally repressive effect of STAT5 on BCL6 appears to be reduced, while the activation of STAT3 seen in endometriosis drives BCL6 over-expression. SIRT1, on the other hand, is regulated by other factors. Estrogen has been shown to increase SIRT1, as well as inflammation-driven miRNAs. miRNA34 has been shown to inhibit SIRT1 and we previously reported that miR34 levels are markedly reduced in women with endometriosis, likely regulated by inflammation. Thus, both SIRT1 and BCL6 over-expression can be regulated through inflammatory cytokines known to be present in women with endometriosis.

Furthermore and importantly, we show that KRAS activation in the mouse uterus is associated with increased SIRT1 proteins and suppressed expression of P target genes including Indian hedgehog pathway genes. P resistance implies a decreased responsiveness of target tissue to bio-available P, and such an impaired P response is seen in the endometrium of women with endometriosis. P resistance is associated with early secretory phase deficiency, early pregnancy loss, or infertility due to endometriosis. Understanding the molecular mechanisms of P resistance is critical to developing better therapeutic approaches to infertility, endometriosis. Therefore, our results suggest KRAS activation causes P resistant through SIRT1 in endometrium. The BCL6/BCOR/SIRT1 complex suppresses growth of human medulloblastoma cells through GLI1 and GLI2 repression. Two SIRT1 and BCL6 binding sites were identified at the proximal promoter region of GLI1 gene. Our ChIP results on chromatin prepared from the Ishikawa epithelial cell line revealed that both SIRT1 and BCL6 were enriched at the same BCL6 binding site of the GLI1 promoters. BCL6/SIRT1 could influence chromatin acetylation patterns at the GLI1 regulatory regions. The chromatin around the GLI1 promoters could be remodeled in a BCL6/SIRT1-dependent manner. BCL6 acts through the recruitment of BCOR corepressor and SIRT1 histone deacetylase, thereby leading to epigenetic repression of GLI1.

In summary, this is the first time that non-mutated KRAS activation has been shown to be strongly correlated with endometrium-associated endometriosis and that this activation triggers specific changes in histone deacetylase, SIRT1, which we postulate is a key driver of progesterone resistance. SIRT1 is highly expressed in the endometrium of patients with endometriosis and appears to be an excellent biomarker in endometrium of women with this disorder. Transcriptional repression of GLI1 relies on recruitment of SIRT1 and BCL6 onto the promoter. These studies identify a primary mechanism of inflammatory dysfunction that contributes to the pathogenesis of endometriosis and may have a role in infertility and pregnancy loss associated with this disease. Progress in our understanding of the etiology and pathophysiology of endometriosis and potential therapeutic interventions by targeted pharmacological agents has been hampered due, in part, to the lack of defined molecular mechanisms. Based on these findings, new therapies targeting these novel pathways may improve treatment options for this enigmatic disease.

Human endometrial tissue samples. The human endometrial samples were collected from Michigan State University's Center for Women's Health Research Female Reproductive Tract Biorepository (Grand Rapids, Mich.), the Greenville Hospital System (Greenville, S.C.), and the University of North Carolina (Chapel Hill, N.C.). Samples were collected as previously reported. Briefly, to compare protein levels in eutopic endometrium from women with and without endometriosis, endometrial biopsies were obtained from regularly cycling women between the ages of 18 and 45. The presence or absence of disease was confirmed during surgery. Women laparoscopically negative for this disease were placed into the control group, whereas women laparoscopically positive for this disease were placed in the endometriosis group. For control eutopic endometrium, 21 samples were collected from the proliferative (n=5) and secretory phase (n=16) for Western blot analysis and 23 samples were collected from the proliferative (n=6) and secretory (n=17) phase for immunohistochemistry analysis. For endometriosis eutopic endometrium, 54 samples were collected from the proliferative (n=16) and secretory (n=38) phase for Western blot analysis and 57 samples were collected for immunohistochemistry analysis. Use of an intrauterine device (IUD) or hormonal therapies in the 3 months preceding surgery was exclusionary for this study. Histologic dating of endometrial samples was performed by a board certified pathologist and subsequently confirmed by an experienced fertility specialist.

Animals and tissue collection. All the experimental mice were maintained in a designated animal care facility according to Michigan State University's Institutional Guidelines for the care and use of laboratory animals. All animal procedures were approved by the Institutional Animal Care and Use Committee of Michigan State University. All animal experiments were performed in accordance with the relevant guidelines and regulations. Kras conditional activated mice were generated by crossing $Pgr^{cre/+}$ with LSL-K-ras$^{G12D/+}$ mice ($Pgr^{cre/+}$ LSL-K-ras$^{G12D/+}$). For the study, female control (LSL-K-ras$^{G12D/+}$ and $Pgr^{cre/+}$) mice were used.

Cytokine measurements. Plasma samples obtained from endometriosis patients and healthy controls were evaluated using a laser bead technology based commercial multiplex assay for the analysis of selected target cytokines such as IL-1, IL-1RA, IL-6 and IL-17 by Eve Tech (Eve Technologies, Calgary, AB, Canada). Briefly, color-coded polystyrene beads were coupled with capture antibodies for each respective target cytokine. After washing twice with 100 µl of wash buffer, 50 µL of sample was added to each well. Following 1-hour incubation, wells were washed 3 times with 100 µL of wash buffer prior to adding 25 µL of detection antibody. 50 µL of streptavidin-PE was added to each well and was incubated for 10 minutes. Beads were re-suspended in 125 µL of assay buffer and the plate was read using Bio Plex 200 Suspension Array System. Fluorescent intensity signals in direct proportion to protein bound to specific analyte beads were analyzed. Observed concentration for each target analyte was calculated against standard curve regression.

Baboon endometrium samples. Endometriosis is induced by intraperitoneal inoculation of menstrual endometrium on two consecutive menstrual cycles and harvested using laparotomy via endometriectomy from five female baboons. Laparotomies were performed at 3, 9, and 15 months post-inoculation to harvest the eutopic endometrial tissues and these endometrial tissues were used for immunohistochemistry analysis.

Western blot analysis. Western blot analyses were performed as described previously. Briefly, eutopic endometrial tissues were lysed with lysis buffer (150 mM NaCl, 10 mM Tris-HCl (pH 7.4), 2.5 mM EDTA, 0.125% Nonidet P-40 (vol/vol), a protease inhibitor cocktail (Roche, Indianapolis, Ind.) and a phosphatase inhibitor cocktail (Sigma Aldrich, St. Louis, Mo.). Equal amounts of total protein (20 µg) were separated on SDS-polyacrylamide gel electrophoresis and transferred onto polyvinylidene difluoride membrane (Millipore Corp., Bedford, Mass.). Membrane was blocked with 0.5% Casein in phosphate buffered saline (PBS) and incubated with antibodies against SIRT1 (9475; Cell Signaling, Danvers, Mass.), BCL6 (561520; BD Pharmingen, San Jose, Calif.), and β-actin (sc1616; Santa Cruz Biotechnology, Santa Cruz, Calif.). Immunoreactivity was visualized by autoradiography and band intensity was determined by relative densitometry using ImageJ (National Institute of Health), and normalized against the bands obtained for β-actin.

Immunohistochemistry and immunofluorescence analyses. Immunohistochemistry and immunofluorescence analyses were performed as previously described. The paraffin-embedded endometrial tissues were blocked with 10% normal serum in PBS (pH 7.5) and then incubated with antibodies against SIRT1 (Cell Signaling), BCL6 (BD Pharmingen) and GLI1 (sc20687; Santa Cruz Biotechnology). For immunohistochemistry, sections were incubated with secondary antibody conjugated to horseradish peroxidase (Vector Laboratories, Burlingame, Calif.). Immunoreactivity was detected using the Vectastain Elite DAB kit (DAB-Vector Laboratories, Burlingame, Calif.) and counterstained with hematoxylin. A semi-quantitative grading system (H-score) was used to compare the immunohistochemical staining intensities as previously described. For immunofluorescence, the sections were exposed to primary antibodies overnight at 4° C. and secondary antibodies (Alexa Fluor 488-conjugated anti-rabbit IgG (Invitrogen, Grand Island, N.Y.) and Alexa Fluor 594-conjugated anti-mouse IgG (Invitrogen) for 2 hour at room temperature. 4',6-diamidino-2-phenylindole (DAPI; Vector Laboratories) was used to enable nuclear visualization.

Immunoprecipitation analysis. Immunoprecipitation analyses were performed as previously described. Protein lysates were immunoprecipitated with anti-SIRT1 (Cell Signaling) antibodies with protein A-agarose (Pierce Biotechnology, Rockford, Ill.) overnight at 4° C. Immunocomplexes were subjected to Western blot analysis using anti-BCL6 (BD Pharmingen) and anti-SIRT1 antibodies (Cell Signaling) antibodies.

Cell culture and treatment. Ishikawa cells, epithelial cells of human endometrial adenocarcinoma, were maintained in Dulbecco's Modified Eagle's Medium with F12 (Gibco, Grand Island, N.Y.) containing 10% fetal bovine serum (FBS; Gibco) and 1% penicillin streptomycin (P/S; Gibco) at 37° C. in 5% $CO_2$. Ishikawa cells were pre-treated with 10 nM estradiol (E2, Sigma-Aldrich, St. Louis, Mo.) for 1 day and restored. After 2 days, these cells were treated with E2+1 µM medroxyprogesterone acetate (MPA; Sigma-Aldrich) and then incubated for the indicated time. All experiments were performed in triplicate.

RNA isolation and quantitative real-time PCR. Total RNA was isolated from mouse uterine tissues or Ishikawa cell pellets using the RNeasy purification kit (Qiagen, Valencia, Calif.) according to the manufacturer's instructions. Then, cDNA were synthesized using quantitative PCR random hexamers and MMLV Reverse Transcriptase (Invitrogen Crop., Carlsbad, Calif.). The expression levels of GLI1 (TaqMan 00494654) were measured by quantitative real-time PCR using RT-PCR Universal Master Mix reagent (Applied Biosystems, Foster City, Calif.) according to the manufacturer's instructions. mRNA quantities were normalized against the housekeeping gene, 18S RNA using ABI rRNA control reagents.

Chromatin immunoprecipitation (ChIP). ChIP analysis was conducted by Active Motif (Carlsbad, Calif.) using Ishikawa cells treated with vehicle or E2+MPA for 24 hours. ChIP assays were performed as previously described. Briefly, 100 µg of chromatin from Ishkawa cells were immunoprecipitated by 4 µg of antibodies against BCL6 (BD Pharmingen). Eluted DNA was amplified with specific primers using SYBR Green Supermix (Bio-Rad Laboratories, Inc., Hercules, Calif.). Primers used in PCR were as follows: BCL6 A (forward: 5'-GTCCTGGGGGTGCAATAAG-3' (SEQ ID NO:153); reverse: 5'-CCCCTCACCTCCCTTCTATT-3' (SEQ ID NO:154)), BCL6 B (forward: 5'-ACTGACCTTCCACACC-CAAG-3' (SEQ ID NO:155); reverse: 5'-GGAG-GAAGCATGACAAGGAA-3' (SEQ ID NO:156)), and negative control (N.C.) (forward: 5'-CCTATCC-CACCCCTTCACCA-3' (SEQ ID NO:157); reverse: 5'-TAGCCTGCCCACCTCAGGAT-3' (SEQ ID NO:158)). The resulting signals were normalized to input activity.

Statistical analysis. Statistical analyses were performed using the Student's t-test for data with only two groups. For data containing more than two groups, we performed an analysis of variance (ANOVA) test and analyzed by Tukey or Bonferroni test for pairwise t-test. All data are presented as means±SEM. p<0.05 was considered statistically significant. All statistical analyses were performed using the Instat package from GraphPad (San Diego, Calif.).

Example 3

Survival Proportions

Figure 14:
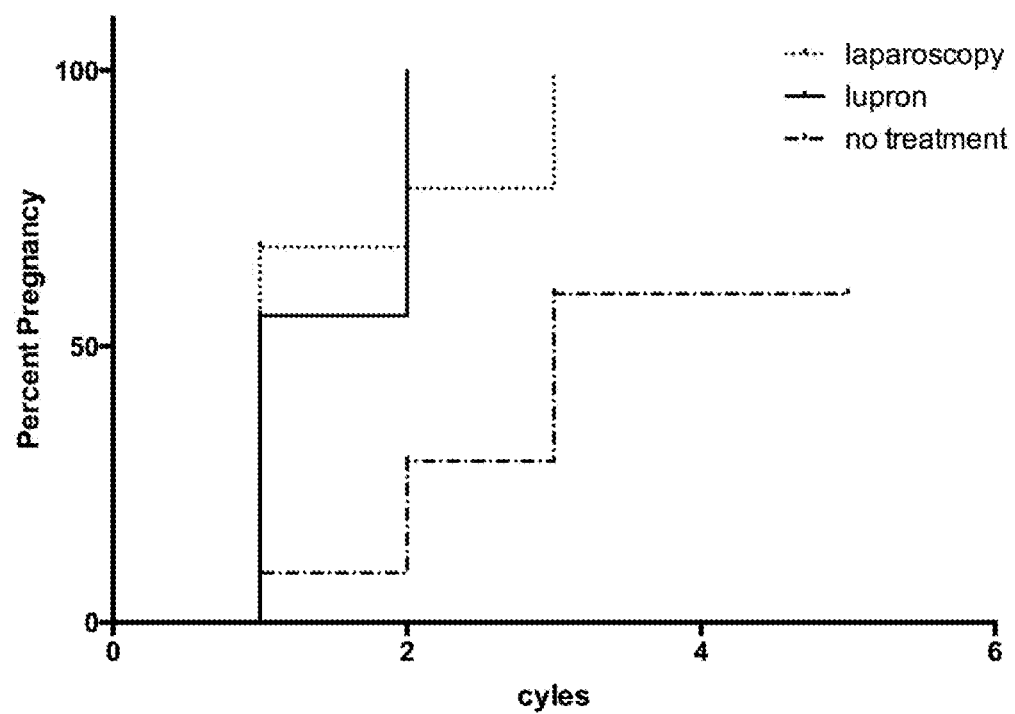
FIG. 14. Survival proportions: survival of three groups.

In vitro fertilized (IVF) ovum transfer or frozen embryo transfer was carried out in BCL6 positive individuals. There were three treatment groups: no treatment prior to transfer, laparoscopy with treatment of endometriosis prior to transfer and GnRH agonist suppression (Lupron) pretreatment for two months prior to transfer. Both treatment groups had a significantly better transplantation rate and time to pregnancy (p<0.0001) compared to no treatment (FIG. 14).

Example 6

SIRT1 and KRAS as Markers for Endometriosis Derived Ovarian Cancer

Immunohistochemical studies showed that K-ras is low in normal control endometrium but appears activated in endometrium of women with endometriosis.

FIGS. 15A and 15B depict data from experiments in which Sirt1 was detected by immunohistochemistry and examined in the nucleus (A) or cytoplasm (B) of samples from the following: Controls (normal endometrium), eutopic endometrium of women with endometriosis (Osis Eutopic), endometriosis implants (Osis Ectopic), ectopic endometriosis in ovarian cancer from women with endometriosis (Osis) or ovarian cancer from women with endometriosis (Ca), endometrial cancer (EC) or ovarian cancer without endometriosis (OC). Findings suggest that nuclear staining for SIRT1 is specifically seen in endometriosis (Osis Eutopic) and in ovarian cancer and endometriosis from women with endometriosis and ovarian cancer. Cytoplasmic SIRT1 is present in ectopic endometriosis and in cancers but not in ectopic endometriosis.

Immunohistochemical studies showed that in a K-ras mutation model mouse {$Pgr^{cre/+}Kras^{G12D}$), SIRT1 is elevated in the uterus of mutant animals but absent in normal uterus (WT).

Figure 15:
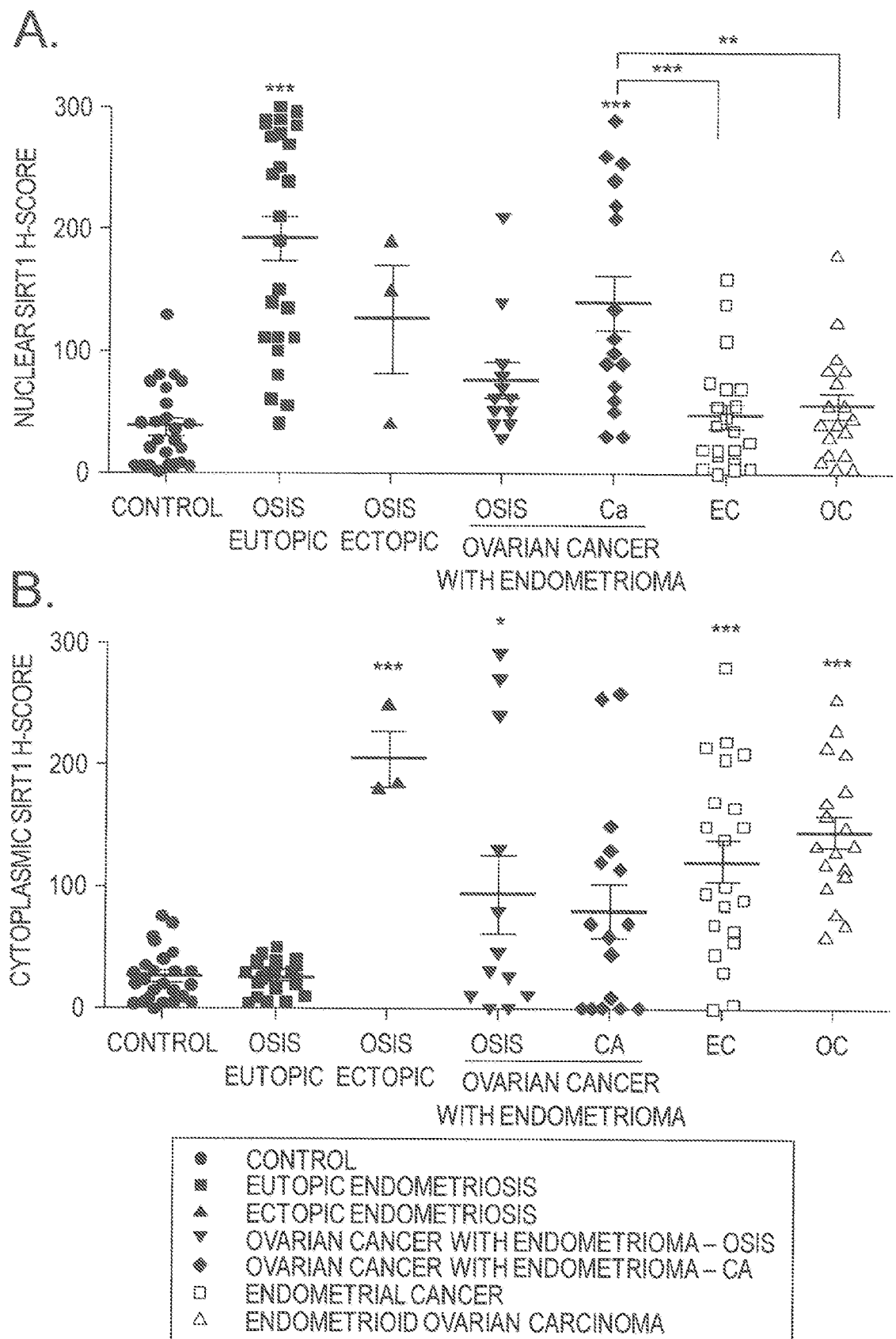
FIGS. 15A and 15B. Levels and localization of SIRT1 protein in eutopic endometrium, endometriotic lesions, and cancer from women with and without endometriosis and/or ovarian cancer. The results represent the mean±SEM. * $p<0.05$,  $p<0.01$, and * $p<0.001$.

Immunohistochemical staining of SIRT1 in normal controls (Control) versus the various groups in FIG. 15 (eutopic endometrium, endometriotic lesions, and cancer from women with and without endometriosis and/or ovarian cancer) supported the findings of nuclear versus cytoplasmic staining.

Western blot analysis showed up-regulation of both SIRT1 and KRAS in eutopic endometrium of women with endometriosis compared to housekeeping gene a-tubulin. There was excellent correlation between KRAS and SIRT1, comparing normal controls to endometriosis cases.

Example 4

Aberrant Over-Expression of SIRT1 and K-Ras Reveals a Mechanism for Progesterone Resistance in Women with Endometriosis Introduction: Endometriosis is an inflammatory condition associated with progesterone resistance, contributing to infertility and pregnancy loss. SIRT1 has an important role in the regulation of inflammatory cytokine expression and promotes cell survival by cooperating with K-Ras. K-Ras is overexpressed in endometrial stromal cells of women with endometriosis. However, the role of SIRT1 in endometriosis and uterine biology remains unknown. We hypothesize that combined, co-regulated over-expression of SIRT1 and K-Ras mediates progesterone resistance in endometrium.

Methods: We examined the expression of SIRT1 and K-Ras in eutopic endometrium from women with and without endometriosis. To investigate the molecular mechanism of SIRT1, we examined progesterone regulated genes using ChIP analysis and mice with constitutive activation of K-Ras.

Results: Western blot and IHC analysis revealed expression of SIRT1, whose abundance was significantly higher in the eutopic endometrium from women with endometriosis as compared to women without the disease, in both the proliferative and secretory phases. SIRT1 and K-Ras protein expression levels were strongly and positively correlated in the endometrium of women with endometriosis. In mice engineered to activate K-Ras in progesterone receptor expressing cells, SIRT1 is increased and the expression of progesterone targets genes, including GLI1, is significantly decreased. ChIP analysis demonstrates binding of SIRT1 to the GLI1 promoter, suggesting a direct effect on transcription of this gene.

Conclusions: Together the data support an effect of K-Ras on SIRT1 expression that, in turn, decreases GLI1 expression. Given the role of GLI1 in the Indian Hedgehog (IHH) pathway, this novel finding suggests a mechanism for the interference in progesterone signaling via inhibition of the IHH pathway in eutopic endometrial stromal cells of women with endometriosis.

Example 5

Aberrant Over-Expression of SIRT1 and K-Ras Reveals a Mechanism for Progersterone Resistance in Women with Endometriosis Endometriosis is a gynecologic disorder defined by the presence of endometrial cells outside of the uterine cavity. Endometriosis adds significantly to health care costs, upwards of $22 billion dollars per year in the US.

Symptoms of endometriosis vary widely and include dysmenorrhea, dyspareunia, noncyclic chronic pelvic pain, and infertility, with a considerable negative impact on quality of life. Endometriosis is a major cause of infertility and pelvic pain. It affects about 5% of reproductive-age women and up to 50% of these are infertile. Surgical removal of ectopic lesions and/or hormonal suppression focused on reducing estrogen, such as progestins, androgens, gonadotropin-releasing hormone (GnRH) agonists, and aromatase inhibitors are the current gold standards of therapy.

However, both approaches are associated with various side effects and a high incidence of relapse. Therefore, identification of mechanisms involved in the pathogenesis of endometriosis and strategic therapies for treatment remain critical. The eutopic endometrium of women with endometriosis exhibits inflammation, aberrant estrogen activity, cellular proliferation and a resistance to progesterone (P4). The biological mechanisms linking endometriotic lesions to these endometrial alterations remain uncertain and controversial. P4 resistance and estrogen dominance likely contribute to the pathophysiology and survival of ectopic lesion and contributes to infertility as well.

KRAS has been proposed as a strong candidate gene in the pathophysiology of endometriosis. Activation of KRAS in mice was associated with endometriosis-like lesions on the peritoneum and ovaries and lesions derived from mice with activated KRAS mutation survived longer in wild type mice. While there is no direct link between KRAS mutations and the risk for endometriosis in humans, inflammation associated events including changes in miRNA expression in endometriosis, may play a role in its activation. We previously showed that miRNA34b was dramatically decreased in eutopic endometrium of women with endometriosis. This miRNA has been shown to have benefit in KRAS induced mouse models of other carcinomas and both let-7b and miRNA 34 have been shown to target KRAS15, and both miR34 and p53 can act synergistically to suppress tumor growth[3].

BCL6 (B Cell Lymphoma 6) is a transcriptional gene repressor and is necessary for B cell development and oncogenesis. BCL6 is up-regulated by STAT3. STAT3 signaling is aberrantly activated in eutopic endometrium from women with endometriosis compared to those without this disease and recently, we reported that BCL6 is highly over-expressed in endometrium from women with endometriosis during the secretory phase of the menstrual cycle compared to women without endometriosis[4].

SIRT1 is a member of the sirtuin family of proteins and homologs to the yeast Sir2 protein. Sirtuin family proteins are Class III HDACs. SIRT1 can deacetylate both histones and non-histone proteins such as p53. Its deacetylation activity enables it to regulate gene transcription and implicates in the influence of a variety of cellular processes such as aging, apoptosis, inflammation, stress resistance, and metabolism. SIRT1 has a dual role as oncogenic function as well as tumor suppressor. According to previous reports, SIRT1 plays a role as a tumor promoter in endometrial cancer by targeting sterol regulatory element binding protein 1 (SREBP1) and lipogenesis. Additionally, SIRT1 has an important role in the regulation of inflammatory cytokines expression in endometriotic stromal cells and SIRT1 has been associated with poor prognosis ovarian cancers. However, the role of SIRT1 in endometriosis and uterine biology has not been examined.

In this study, we investigated the levels of KRAS and SIRT1 proteins in endometrium from women with and without endometriosis. The levels of SIRT1 and KRAS were compared in endometrium of women with and without endometriosis. Using a mouse model, we investigated the potential link between KRAS activation and SIRT1 expression. We report here for the first time in endometrium, a direct protein-protein interaction between SIRT1 and BCL6 in human endometrial tissue, co-localizing in the nuclei of endometriosis cases. Further, we show that GLI1, a promoter target for both BCL6 and SIRT1, is reduced in eutopic endometrium of women with this disease. Based on these results we suggest that aberrant overexpression of SIRT1 is driven by KRAS activation and co-localizes with BCL6, contributing to the phenomenon of progesterone resistance through gene inactivation of the GLI1 promoter.

Non-mutated KRAS activation has been shown to be strongly correlated with endometrium-associated endometriosis and this activation triggers specific changes in histone deacetylase, SIRT1 which we postulate is a key driver of progesterone resistance.

SIRT1 is highly expressed in the endometrium of patients with endometriosis and appears to be an excellent biomarker in endometrium of women with this disorder.

Transcriptional repression of GLI1 relies on recruitment of SIRT1 and BCL6 onto the promoter.

All references listed herein, including but not limited to all patents, patent applications and publications thereof, scientific journal articles, and database entries (including but not limited to GENBANK® biosequence database entries and all annotations available therein) are incorporated herein by reference in their entireties to the extent not inconsistent herewith and to the extent that they supplement, explain, provide a background for, or teach methodology, techniques, and/or compositions employed herein.

It will be understood that various details of the presently disclosed subject matter may be changed without departing from the scope of the presently disclosed subject matter. Furthermore, the foregoing description is for the purpose of illustration only, and not for the purpose of limitation.

TABLE 1

Exemplary Non-human BCL6 Orthologous Sequences

| Species | Nucleotide[1] | Amino Acid[1] |
|---|---|---|
| Pan paniscus | XM_003824955 (SEQ ID NO: 7) | XP_003825003 (SEQ ID NO: 8) |
| | XM_008978648 (SEQ ID NO: 9) | XP_008976896 (SEQ ID NO: 10) |
| | XM_008978646 (SEQ ID NO: 11) | XP_008976894 (SEQ ID NO: 12) |
| Pan troglodytes | XM_001158812 (SEQ ID NO: 13) | XP_001158812 (SEQ ID NO: 14) |
| | XM_009446993 (SEQ ID NO: 15) | XP_009445268 (SEQ ID NO: 16) |
| | XM_009446989 (SEQ ID NO: 17) | XP_009445264 (SEQ ID NO: 18) |
| Chlorocebus sabaeus | XM_008009503 (SEQ ID NO: 19) | XP_008007694 (SEQ ID NO: 20) |
| | XM_008009504 (SEQ ID NO: 21) | XP_008007695 (SEQ ID NO: 22) |
| | XM_008009507 (SEQ ID NO: 23) | XP_008007698 (SEQ ID NO: 24) |
| Saimiri boliviensis boliviensis | XM_003927003 (SEQ ID NO: 25) | XP_003927052 (SEQ ID NO: 26) |
| | XM_010337713 (SEQ ID NO: 27) | XP_010336015 (SEQ ID NO: 28) |
| | XM_010337712 (SEQ ID NO: 29) | XP_010336014 (SEQ ID NO: 30) |
| Pongo abelii | NM_001159790 (SEQ ID NO: 31) | NP_001153262 (SEQ ID NO: 32) |
| Gorilla gorilla gorilla | XM_004038190 (SEQ ID NO: 33) | XP_004038238 (SEQ ID NO: 34) |
| Orcinus orca | XM_004278481 (SEQ ID NO: 35) | XP_004278529 (SEQ ID NO: 36) |
| | XM_004278482 (SEQ ID NO: 37) | XP_004278530 (SEQ ID NO: 38) |
| Canis lupus familiaris | XM_005639719 (SEQ ID NO: 39) | XP_005639776 (SEQ ID NO: 40) |
| | XM_005639720 (SEQ ID NO: 41) | XP_005639777 (SEQ ID NO: 42) |
| | XM_005639722 (SEQ ID NO: 43) | XP_005639779 (SEQ ID NO: 44) |
| Equus caballus | XM_001499782 (SEQ ID NO: 45) | XP_001499832 (SEQ ID NO: 46) |
| | XM_005601882 (SEQ ID NO: 47) | XP_005601939 (SEQ ID NO: 48) |
| | XM_003363354 (SEQ ID NO: 49) | XP_003363402 (SEQ ID NO: 50) |
| Felis catus | XM_006936189 (SEQ ID NO: 51) | XP_006936251 (SEQ ID NO: 52) |
| | XM_003991804 (SEQ ID NO: 53) | XP_003991853 (SEQ ID NO: 54) |
| Felis catus (cont'd) | XM_006936190 (SEQ ID NO: 55) | XP_006936252 (SEQ ID NO: 56) |
| Bos taurus | NM_001206450 (SEQ ID NO: 57) | NP_001193379 (SEQ ID NO: 58) |
| | XM_005201513 (SEQ ID NO: 59) | XP_005201570 (SEQ ID NO: 60) |
| Rattus norvegicus | NM_001107084 (SEQ ID NO: 61) | NP_001100554 (SEQ ID NO: 62) |
| | XM_008768799 (SEQ ID NO: 63) | XP_008767021 (SEQ ID NO: 64) |
| | BC166425 (SEQ ID NO: 65) | AAI66425 (SEQ ID NO: 66) |

TABLE 1-continued

Exemplary Non-human BCL6 Orthologous Sequences

| Species | Nucleotide[1] | Amino Acid[1] |
|---|---|---|
| Mus musculus | NM_009744 (SEQ ID NO: 67) | NP_033874 (SEQ ID NO: 68) |
| | AK039228 (SEQ ID NO: 69) | BAC30286 (SEQ ID NO: 70) |
| | AK036975 (SEQ ID NO: 71) | BAC29654 (SEQ ID NO: 72) |

[1]Listed are exemplary GENBANK® biosequence database Accession Nos.

TABLE 2

Exemplary Non-human ITGB3 Orthologous Sequences

| Species | Nucleotide[1] | Amino Acid[1] |
|---|---|---|
| Gorilla gorilla gorilla | XM_004041453 (SEQ ID NO: 77) | XP_004041501 (SEQ ID NO: 78) |
| Chlorocebus sabaeus | XM_008012292 (SEQ ID NO: 79) | XP_008010483 (SEQ ID NO: 80) |
| | XM_008012293 (SEQ ID NO: 81) | XP_008010484 (SEQ ID NO: 82) |
| Macaca mulatto | XM_005584610 (SEQ ID NO: 83) | XP_005584667 (SEQ ID NO: 84) |
| | XM_001116013 (SEQ ID NO: 85) | XP_001116013 (SEQ ID NO: 86) |
| Pan troglodytes | XM_523684 (SEQ ID NO: 87) | XP_523684 (SEQ ID NO: 88) |
| Pongo abelii | XM_002834317 (SEQ ID NO: 91) | XP_002834363 (SEQ ID NO: 92) |
| | XM_009236637 (SEQ ID NO: 93) | XP_009234912 (SEQ ID NO: 94) |
| Orcinus orca | XM_004275670 (SEQ ID NO: 95) | XP_004275718 (SEQ ID NO: 96) |
| | XM_004275671 (SEQ ID NO: 97) | XP_004275719 (SEQ ID NO: 98) |
| Canis lupus familiaris | NM_001003162 (SEQ ID NO: 99) | NP_001003162 (SEQ ID NO: 100) |
| | XM_005624174 (SEQ ID NO: 101) | XP_005624231 (SEQ ID NO: 102) |
| Equus caballus | NM_001081802 (SEQ ID NO: 103) | NP_001075271 (SEQ ID NO: 104) |
| Felis catus | XM_003997035 (SEQ ID NO: 105) | XP_003997084 (SEQ ID NO: 106) |
| Bos taurus | NM_001206490 (SEQ ID NO: 107) | NP_001193419 (SEQ ID NO: 108) |
| Sus scrofa | NM_214002 (SEQ ID NO: 109) | NP_999167 (SEQ ID NO: 110) |
| | AF170527 (SEQ ID NO: 111) | AAD51953 (SEQ ID NO: 112) |
| Saimiri boliviensis boliviensis | XM_010330277 (SEQ ID NO: 113) | XP_010328579 (SEQ ID NO: 114) |
| | XM_010330278 (SEQ ID NO: 115) | XP_010328580 (SEQ ID NO: 116) |

[1]Listed are exemplary GENBANK® biosequence database Accession Nos.

TABLE 3

Exemplary Non-human SIRT Orthologous Sequences

| Species | Nucleotide[1] | Amino Acid[1] |
|---|---|---|
| Gorilla gorilla gorilla | XM_004049482 (SEQ ID NO: 121) | XP_004049530 (SEQ ID NO: 122) |
| | XM_004049484 (SEQ ID NO: 123) | XP_004049532 (SEQ ID NO: 124) |
| Mus musculus | NM_001159589 (SEQ ID NO: 125) | NP_001153061 (SEQ ID NO: 126) |
| | NM_019812 (SEQ ID NO: 127) | NP_062786 (SEQ ID NO: 128) |
| Rattus norvegicus | XM_006256146 (SEQ ID NO: 129) | XP_006256208.2 (SEQ ID NO: 130) |

TABLE 3-continued

Exemplary Non-human SIRT Orthologous Sequences

| Species | Nucleotide[1] | Amino Acid[1] |
|---|---|---|
| Sus scrofa | NM_001145750 (SEQ ID NO: 131) | NP_001139222 (SEQ ID NO: 132) |
| Bos taurus | NM_001192980 (SEQ ID NO: 133) | NP_001179909 (SEQ ID NO: 134) |
| Felis cattus | NM_001290246 (SEQ ID NO: 135) | NP_001277175 (SEQ ID NO: 136) |
| Canis lupus familiaris | XM_546130 (SEQ ID NO: 137) | XP_546130 (SEQ ID NO: 138) |
|  | XM_005618933 (SEQ ID NO: 139) | XP_005618990.1 (SEQ ID NO: 140) |
| Pan troglodytes | XM_003312580 (SEQ ID NO: 141) | XP_003312628 (SEQ ID NO: 142) |
|  | XM_003312581 (SEQ ID NO: 143) | XP_003312629 (SEQ ID NO: 144) |
| Equus caballus | XM_014733098 (SEQ ID NO: 145) | XP_014588584.1 (SEQ ID NO: 146) |
| Macaca mulatta | XM_015147516 (SEQ ID NO: 147) | XP_015003002 (SEQ ID NO: 148) |
|  | XM_015147517 (SEQ ID NO: 149) | XP_015003003 (SEQ ID NO: 150) |
| Pongo abelii | XM_002820895 (SEQ ID NO: 151) | XP_002820941 (SEQ ID NO: 152) |

[1]Listed are exemplary GENBANK ® biosequence database Accession Nos.

SEQUENCE LISTING (164 sequences)

SEQ ID NO: 1 - DNA, 3575 bp, Homo sapiens
  CDS (366)..(2486)
accatcgtcttgggcccggggagggagagccaccttcaggcccctcgagcctcgaaccggaacctccaaatccgagacgctctgcttatgaggacctcgaaatatgccggccagtgaaaaaatcttgtggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactggaaaaaaaa

SEQ ID NO: 2 - protein, 706 aa, Homo sapiens
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVSAIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCHSNIYSPKETIPEEARSDMHYSVAEGLKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 3 - DNA, 3662 bp, Homo sapiens
  CDS (458)..(2578)
gcgagctggtggttgaagctggttaaagaacagcctaggtattccagaagtgtttgaggatcccttccatgaaggaagagaggaaagtttttaagtaaacctcccactcccatgtgtcttcagctttcttttgcaaaggagaaaatccttgaagtttggtaaagaccgagttagtctatctctctttgcctatctcgagttgggctggggagaggaggagataggttcttttgtctttttctgtcttctcccttccccacttccttccctccagtccccactcactcacatgcacacactaaccttggagccgatgggattgagtgactggcacttgggaccacagagaaatgtcagagtgtttggttacagactcaaggaaacctctcattttagagtgctcatttggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactggaaa

SEQ ID NO: 4 - protein, 706 aa, Homo sapiens; identical to SEQ ID NO: 2

SEQ ID NO: 5 - DNA, 3086 bp, Homo sapiens
  CDS (50)..(2002)
gttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactggaaa

SEQ ID NO: 6 - protein, 650 aa, Homo sapiens
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVSAIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCHSNIYSPKETIPEEARSDMHYSVAEGLKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 7 - DNA, 3562 bp, Pan paniscus
  CDS (366)..(2486)
accatcgtcttgggcccggggagggagagccaccttcaggcccctcgagcctcgaaccggaacctccaaatccgagacgctctgcttatgaggacctcgaaatatgccggccagtgaaaaaatcttgtggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggactttatgtacacatctcggctcaatttgcgggagggcaacatcatggctgtgatggccacggctatgtacctgcagatggagcatgttgtggacacttgccggaagtttatcaaggccagtgaagcagagatggttcctgccatcaagccccctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacagtcccagaagaggcacgaagtgatatgcactacagtgtggctgagggcctcaagcctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaactaagctcagtgccagcggggaggactccaccatcccacaagccagccggctcaataacatcgttaacaggtccatgacgggctctccccgcagcagcagcgagagccactcaccactgtacatgcaccccccgaagtgcacgtcctgcggctctcagtccccacagcacgcagagatgtgcctccacaccgctggccccacgttccctgaggagatgggagagacccagtctgagtactcagattctagctgtgagaacggggccttcttctgcaatgagtgtgactgtcgcttctctgaggaggcctcactcaagaggcacacgctgcagacccacagcgacaaaccctacaagtgtgaccgctgccaggcctccttccgctacaagggcaacctcgccagccacaagaccgtccatactggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccacgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacagtgttcatcccatgatgtagtgcctctttcatccactagtgcaaatcatagctgggggtggggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttatcaaagagagggctttaatttttttaaccaaaggtgaaggaatatatggcagagttgtaaatatataaatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcgccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaa

SEQ ID NO: 8 - protein, 706 aa, Pan paniscus
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVPAIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCHSNIYSPKETVPEEARSDMHYSVAEGLKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 9 - DNA, 6297 bp, Pan paniscus
  CDS (3101)..(5221)
gagttagtgacttaaccaggaccagattttaagcttctgaatttcatgtcagtgactgaaagtcaaaggcgggtttatctcagctcctttgaagtatttatgagaaaggagcggctgccagaaccatgagtttaacctcttaggccacctttgttgccagtgttcattggaaaccgctccccagcagtcttggaggattcttttttaaagaaaatatggcctaagattttcggtaatgacacgaaaagcccagatggtgctgaagggtgtgggtctcggagctcgggggtttgcgtgttaagaggggggttaaggcctggaccaaagacttgcagggcgagcctcgattctgaaatcgctctcttccccttcctaacatcctctgcatagtagcctggcgagaaaccgggtgtgtgtgtgtgagggggtgggggtcatgtggataggccagaatttgtgccacaacagttcctccgtaaagttttctttctccgagctcgtgacttaagatggcaaacgcgcgtccgcatgctggcggcccctagcggcagcaggcgcgctctgcagggggagacagcgccgtctcccccgcccgggtcggcggggatcgagttcggcctctcccactgcgggagccgtcggaggccgcgtcggagaaacgcgcctctgttcggactggaaacgaatctgggaacgagtttgaagcgcggtcaagtttgactcatcgccttccaaggacagttagtgccttccatcttcattaacgtgaataaggaccttggctgacttctttccagatcggatttttaaaggcattgtttgcttgaggagatcatgcttctcccctcccccgccagcctttttgcaaaggctgagcccagtccagccaggacggccgagggatctctgctccgggacgcgatttgctggcattgtcttcgggcccttctggaaggctgtctcgcgctgagcgtatggggaacgtcccttctgcaactcctcttcagatcttgaagataaaacacatccctctgttttattgcatttcctagaagcttgcaggcttgcaagagcactgttggcaggaaacgtgatagaaatgaaagtcaggacacaatgtccccgaacacctcggttatccaaagcggctgccgaggccatcgcgttatcaaattcgcttttatttactgtcgtctcctgcgccctcccgttccccagccaagagggcgaagagtgttttcccccaagaataaaaacagctccgcgatttgacctcgccccctgccgccggaccacggtggtgtctgcagccgtgcagctagttggctgaaacactgctgagaccgggagccccacggcagggcccctgatgcggggttcactacggcagttccagccttattaaaattccttgtccttgtccctaaacagtgctttacactttcagatttccctttggatttttcagcgggttattggagttattagattaccaataatccaacagcctctgtagcctctctggctggagaggaggggggaagggcggaaggcattctccaaatcgggaggctctggccaaactgggtcaatgggaaggaggggaggggcgagaaaggggttgacagtttcaaaccttgatggagggctctctctagcgttaggcagcggtaaaaacaccattcggtttgagctcccggaaccacgggactcctaatttccaataaaggcacttacttcattttaacttcccagattctcatccctaccccttattaaatcccaaccgtctctttcacctttatcccaccgggcgaagaggtgagaaagcctcaatgtaggattttgaggccaaaggctccgtctttgcagaccgactctgacccttccgcttgccgcagaagggatgagcggcgcagtgtgacgccactggctagttttaggaccagactgcggcctttgtggctgagtctttcgctgtcccctagcccccgaaagcgcaccccggagcctgctaccgagaccaattaggacatggcacccggggattataattcccgggagggccacaggaaggcgaggcaactttggagagtgccagtgcgcgcgcaggggtcggggtcccggcctttgccgagtccaagctgtgtctctacggtttcggggaaatcggattcggaaatccttacggcttggcagctcctattctaaagactttgggcggaaaccaagtggagctgggttcccgttcttgccaacgtaggcggaaggggctttctgtttagtttttctccaaccttgcctggggcgcctatgatggagaccctcagcccctagggactccatcttttgaccttgaagtctcgctcaaacattcccctaaaagaacggggatgagggagaatggaaggcaaaaagagggaaaaaagcaaataaacctcggaatcggacaacttaaagtctcgatatgagcctcggattgtattcgaactcctgggttctagacccagctctgctactaacttgtctgaccttccccatttataaactgttgtggatgagaggctggactaggtgaactcagagccctgcactcggcgcggacgagggatttaggggaaagtgtgctgtattccccgcgagccttccccagcggccccgcctccccgggtgaatccccggcggccagcgcagcgcaggcagcgatcctggcggctgccggggcccggcagcttcctggaaagttacttcttgttggagccggcgataggcaaagtgtgttctgtgaaatccgcagagccgagattgactacgttccgggaatgagagggctgtgtcattcccctcattgcctgctgccttgacggcgtaacaggaaaaaaaaaaaaaaaaaaggacatacacacaatgttagctaccgaggtgcacgaaaagttttatttgaatgtaactaaattaagggccgccacggtcataccacaaagcctccgtcgcgccttgcggggggcttcgaggcggatcgcccaggggcgggcagtccctggaagacaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggactttatgtacacatctcggctcaatttgcgggagggcaacatcatggctgtgatggccacggctatgtacctgcagatggagcatgttgtggacacttgccggaagtttatcaaggccagtgaagcagagatggttcctgccatcaagccccctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacagtcccagaagaggcacgaagtgatatgcactacagtgtggctgagggcctcaagcctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaactaagctcagtgccagcggggaggactccaccatcccacaagccagccggctcaataacatcgttaacaggtccatgacgggctctccccgcagcagcagcgagagccactcaccactgtacatgcaccccccgaagtgcacgtcctgcggctctcagtccccacagcacgcagagatgtgcctccacaccgctggccccacgttccctgaggagatgggagagacccagtctgagtactcagattctagctgtgagaacggggccttcttctgcaatgagtgtgactgtcgcttctctgaggaggcctcactcaagaggcacacgctgcagacccacagcgacaaaccctacaagtgtgaccgctgccaggcctccttccgctacaagggcaacctcgccagccacaagaccgtccatactggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccacgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacagtgttcatcccatgatgtagtgcctctttcatccactagtgcaaatcatagctgggggtggggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttatcaaagagagggctttaatttttttaaccaaaggtgaaggaatatatggcagagttgtaaatatataaatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcgccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaa

SEQ ID NO: 10 - protein, 706 aa, Pan paniscus; identical to SEQ ID NO: 8

SEQ ID NO: 11 - DNA, 4530 bp, Pan paniscus
  CDS (1334)..(3454)
ccgaagctcaaattccgagaattgagctctgttgattcttagaactggggttcttagaagtggtgatgcaagaagtttctaggaaaggccggacaccagctcttttaaaggatctgtcttctcaaggagcctagttggctatgcacaaggaaagcgccaaaagagctaaagggaggaagggaagagaaaacatttaactctcccatggtggttactgacccagcgtgggtgcggggagattgggatgggaagtccaggtctgggggcagccagcagttgtcagtttctcattgacagccctgctccttggagattgtttttgtgggtagtcttgtgtgtggcattggtggaatggctgaatctaggagacgcggcgtgtccagaacttgctggaaattggttttgagattttgggcaaggcctctcacccggagcctcagttccctccctaataaagcagggctgttataaggataagatgcaatcgtgagggggtgggaaaggactaagagctctgtaaaaatacaaaccaaatgctggtggtgcttccacacctgcggcatttggggtgggggtggtgacaacattgcccacactcaacccacacactcaggagttggggggggctggttcttaagacgagttggcttgcaaaggagtgaacttgagaaggacctgcgcctcgtgtatgtacatttgtttttggccaggcagaggcttacggtgaaaagcccaaggtccagctgacagtggacacaggggaatttgtttgtttgtttcaatccgcatctggagtgagtcattgccacttgtcatagtgaaatggcaaatctgggcttcctgtggttccagaagcctgcgactggaaatccacaagcgagctggtggttgaagatggttaaagaacagcctaggtattccagaagtgtttgaggatcccttccatgaaagaagagaggaaagtttataagtaaacctcccactcccatgtgtcttcagctttcttttgcaaaggagaaaatccttgaagtttggtaaagaccgagttagtctatctctctttgcctatctcgagttgggctggggagaggaggagataggttcttttgtctttttctgtcttctcccttccccacttccttccctccagtccccactcactcacatgcacacactaaccttggagccgatgggattgagtgactggcacttgggaccacagagaaatgtcagagtgtttggttacagactcaaggaaacctctcattttagagtgctcatttggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggactttatgtacacatctcggctcaatttgcgggagggcaacatcatggctgtgatggccacggctatgtacctgcagatggagcatgttgtggacacttgccggaagtttatcaaggccagtgaagcagagatggttcctgccatcaagccccctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacagtcccagaagaggcacgaagtgatatgcactacagtgtggctgagggcctcaagcctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaactaagctcagtgccagcggggaggactccaccatcccacaagccagccggctcaataacatcgttaacaggtccatgacgggctctccccgcagcagcagcgagagccactcaccactgtacatgcaccccccgaagtgcacgtcctgcggctctcagtccccacagcacgcagagatgtgcctccacaccgctggccccacgttccctgaggagatgggagagacccagtctgagtactcagattctagctgtgagaacggggccttcttctgcaatgagtgtgactgtcgcttctctgaggaggcctcactcaagaggcacacgctgcagacccacagcgacaaaccctacaagtgtgaccgctgccaggcctccttccgctacaagggcaacctcgccagccacaagaccgtccatactggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccacgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacagtgttcatcccatgatgtagtgcctctttcatccactagtgcaaatcatagctgggggtggggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttatcaaagagagggctttaatttttttaaccaaaggtgaaggaatatatggcagagttgtaaatatataaatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcgccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaa

SEQ ID NO: 12 - protein, 706 aa, Pan paniscus; identical to SEQ ID NO: 8

SEQ ID NO: 13 - DNA, 3851 bp, Pan troglodytes
  CDS (653)..(2773)
  misc_feature (2943)..(2944): n is a, c, g, or t
  misc_feature (2946)..(2950): n is a, c, g, or t
  misc_feature (2952)..(2952): n is a, c, g, or t
  misc_feature (2954)..(2954): n is a, c, g, or t
  misc_feature (2956)..(2958): n is a, c, g, or t
atttttttttttctcttactcgcctctctaaccctactatatatataacatactttccccagtggttcaaacctctcgctcccttttgtgcatttagctcgatctgctgagtttatgggtaagaaagaaggaattagccccagaccccgggaaagcaaagcgcactccccctcttatgtcaccgaatagcaaattagttctcagaattccagaggccgagctttgctacagcgaaggcgccgacgtcacagaggaggagcccacgtgacggtggcggagcaggccataccatcgtcttgggcccggggagggagagccaccttcaggcccctcgagcctcgaaccggaacctccaaatccgagacgctctgcttatgaggacctcgaaatatgccggccagtgaaaaaatcttgtggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggactttatgtacacatctcggctcaatttgcgggagggcaacatcatggctgtgatggccacggctatgtacctgcagatggagcatgttgtggacacttgccggaagtttattaaggccagtgaagcagagatggttcctgccatcaagccccctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacagtcccagaagaggcacgaagtgatatgcactacagtgtggctgagggcctcaagcctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctcagtgccagcggggaggactccaccatcccacaagccagccggctcaataacatcgttaacaggtccatgacgggctctccccgcagcagcagcgagagccactcaccactgtacatgcaccccccgaagtgcacgtcctgcggctctcagtccccacagcacgcagagatgtgcctccacaccgctggccccacgttccctgaggagatgggagagacccagtctgagtactcagattctagctgtgagaacggggccttcttctgcaatgagtgtgactgtcgcttctctgaggaggcctcactcaagaggcacacgctgcagacccacagcgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccacgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggtggggggtggtgggggtcggggcctgggggactgggagnngnnnnngntncnnntcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttatcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcgccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaa

SEQ ID NO: 14 - protein, 706 aa, Pan troglodytes; identical to SEQ ID NO: 8

SEQ ID NO: 15 - DNA, 3250 bp, Pan troglodytes
  CDS (52)..(2172)
  misc_feature (2342)..(2343): n is a, c, g, or t
  misc_feature (2345)..(2349): n is a, c, g, or t
  misc_feature (2351)..(2351): n is a, c, g, or t
  misc_feature (2353)..(2353): n is a, c, g, or t
  misc_feature (2355)..(2357): n is a, c, g, or t
aggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggactttatgtacacatctcggctcaatttgcgggagggcaacatcatggctgtgatggccacggctatgtacctgcagatggagcatgttgtggacacttgccggaagtttattaaggccagtgaagcagagatggttcctgccatcaagccccctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacagtcccagaagaggcacgaagtgatatgcactacagtgtggctgagggcctcaagcctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctcagtgccagcggggaggactccaccatcccacaagccagccggctcaataacatcgttaacaggtccatgacgggctctccccgcagcagcagcgagagccactcaccactgtacatgcaccccccgaagtgcacgtcctgcggctctcagtccccacagcacgcagagatgtgcctccacaccgctggccccacgttccctgaggagatgggagagacccagtctgagtactcagattctagctgtgagaacggggccttcttctgcaatgagtgtgactgtcgcttctctgaggaggcctcactcaagaggcacacgctgcagacccacagcgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccacgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggtggggggtggtgggggtcggggcctgggggactgggagnngnnnnngntncnnntcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttatcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcgccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaa

SEQ ID NO: 16 - protein, 706 aa, Pan troglodytes; identical to SEQ ID NO: 8

SEQ ID NO: 17 - DNA, 4495 bp, Pan troglodytes
  CDS (1297)..(3417)
  misc_feature (3587)..(3588): n is a, c, g, or t
  misc_feature (3590)..(3594): n is a, c, g, or t
  misc_feature (3596)..(3596): n is a, c, g, or t
  misc_feature (3598)..(3598): n is a, c, g, or t
  misc_feature (3600)..(3602): n is a, c, g, or t
ctctctctctttgcttttttttttttttttttttggttcctgttttcttcttcaatggaaagctcttttaaaggatctgtcttctcaaggagcctagttggctatgcacaaggaaagcgccaaaagagctaaagggaggaagggaagagaaaacatttaactctcccatggtggttactgacccagcgtgggtgcggggagattgggatgggaagtccaggtctgggggcagccagcagttgtcagtttctcattgacagccctgctccttggagattgtttttgtgggtagtcttgtgtgtggcattggtggaatggctgaatctaggagacgcggcatgtccagaacttgctggaaattggttttgagattttgggcaaggcctctcacccggagcctcagttccctccctaataaagcagggctgttataaggataagatgcaatcgtgagggggtgggaaaggactaagagctctgtaaaaatacaaaccaaatgctggtggtgcttccacacctgcggcatttggggtgggggtggtgacaacattgcccacactcaacccacacactgaggagttggggggagctggttcttaagacgagttggcttgcaaaggagtgaacttgagaaggacctgcgcctcgtgtatgtacatttgtttttggccaggcagaggcttacggtgaaaagcccaaggtccagctgacagtggacacaggggaatttgtttgtttgtttcaatccgcatctggagtgagtcattgccacttgtcatggtgaaatggcaaatctgggcttcctgtggttccagaagcctgcgactggaaatccacaagcgagctggtggttgaagatggttaaagaacagcctaggtattccagaagtgtttgaggatcccttccatgaaagaagagaggaaagtttataagtaaacctcccactcccatgtgtcttcagctttcttttgcaaaggagaaaatccttgaagtttggtaaagaccgagttagtctatctctctttgcctatctcgagttgggctggggagaggaggagataggttcttttgtctttttctgtcttctcccttccccacttccttccctccagtccccactcactcacatgcacacactaaccttggagccgatgggattgagtgactggcacttgggaccacagagaaatgtcagagtgtttggttacagactcaaggaaacctctcattttagagtgctcatttggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggactttatgtacacatctcggctcaatttgcgggagggcaacatcatggctgtgatggccacggctatgtacctgcagatggagcatgttgtggacacttgccggaagtttattaaggccagtgaagcagagatggttcctgccatcaagccccctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacagtcccagaagaggcacgaagtgatatgcactacagtgtggctgagggcctcaagcctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctcagtgccagcggggaggactccaccatcccacaagccagccggctcaataacatcgttaacaggtccatgacgggctctccccgcagcagcagcgagagccactcaccactgtacatgcaccccccgaagtgcacgtcctgcggctctcagtccccacagcacgcagagatgtgcctccacaccgctggccccacgttccctgaggagatgggagagacccagtctgagtactcagattctagctgtgagaacggggccttcttctgcaatgagtgtgactgtcgcttctctgaggaggcctcactcaagaggcacacgctgcagacccacagcgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccacgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggtggggggtggtgggggtcggggcctgggggactgggagnngnnnnngntncnnntcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttatcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcgccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaa

SEQ ID NO: 18 - protein, 706 aa, Pan troglodytes; identical to SEQ ID NO: 8

SEQ ID NO: 19 - DNA, 3711 bp, Chlorocebus sabaeus
  CDS (512)..(2632)
tcgtggaatcattctaagacttgaaagataatattgtagcaggttttgaatgacgtccagtatatttaggtcacagacggatcattattgttaatgttgacagaaccatttttcttgttttttatttcccataaactcaagtggcctttggatggtatatattttttctttgaagaaggaaatgtatgtatgtatgtatgtatgtatgtataactaattaatgtatgcaattgtactcccagtactcaggataaaaacattattatctcatagctttgggtgcctgttgttttcgtaagagcagagctggaaaatgtttgttagcttgtggtaaaaccacaccagctggcaagctgcaactatcaaagcaaaactaaatgtgtgtgtcctaaaataagactatagtggacaatcttacattcgttaaatcaatttctgtttgctttcttctcttctctgcaggttttgagcaaaattttggactgtgaagcaaggcattggtgaagacaaaatggcctcgccggctgacagctgcatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatcttcacagaccagttgaaatgcaaccttagtgtgatcaatctagatcctgagatcaaccctgagggcttctgcatcctcctggactttatgtacacatctcggctcaatttgcgggagggcaacatcatggctgtgatggccacagctatgtacttgcagatggagcatgttgtggacacctgccggaagtttatcaaggccagtgaagcagagatggttcctgccatcaagccccgtcacgaagagttcctcaacagccgcatgctgatgcctcaagacatcatggcctatcggggtcgtgaggtggtggagaacaacctgccactgaggaacgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggccctgccgtgcgatagtaccaggccagtccccggtgagtacagccggccggccttggaggtgtcccccagtgtgtgccacagcaatatctattcacccaaggaaacagtcccagaagaggcacgaagcgatatgcactacagtgtggctgagggcctcaagcctgctgccccctcagcccgaaatgccccctacttcccctgtgacaaggccagcaaagaagaagagagaccctcctcagaagatgagattgccctgcatttcgagccccccaatgcacccctgaaccggaagggtctggttagtccacagagcccccagaaatctgactgccagcccaactcgcccacagaatcctgcagcagtaagaatgcctgcatcctccaggcctctggctcccctccagccaagagccccactgaccccaaagcctgcaactggaagaaatacaagttcatcgtgctcaacagcctcaaccagaatgccaaaccagaggggccagagcaggctgagctgggccgcctttccccacgagcctacactgccccacctgcctgccagccacctatggagcctgagaaccttgacctccagtccccaaccaagctcagtgccagcggggaggactccaccatcccgcaagccagccggctcaataacatcgttaacaggtccctgacaggctctccccgcagcagcagtgagagccactcaccactctacatgcaccccccgaagtgcacgtcctgcggctctcagtccccacagcatgcagagatgtgcctccacaccgccggccccacgttccctgaggagatgggagagacccagtctgagtactcagattccagctgtgagaacggggccttcttctgcaatgagtgtgactgccgcttctctgaggaggcctcactcaagaggcacacgctgcagacccacagtgacaaaccctacaagtgtgatcgctgccaggcctccttccgctacaagggcaacctcgccagccacaagaccgtccatacgggtgagaaaccgtatcgctgcaacatctgtggggcccagttcaaccgaccagccaacctgaaaacccacactcgaatccactctggagagaagccctacaaatgcgaaacctgtggagccagatttgtacaggtggcgcacctccgtgcccacgtgctcatccacactggtgagaagccctatccctgtgaaatctgtggcacccgtttccggcaccttcagactctgaagagccatctgcgaatccacacgggagagaaaccttaccattgtgagaagtgtaacctgcatttccgtcacaaaagccagctgcgacttcacttgcgccagaagcatggtgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggtggggggtggtgggggtcggggcctgggggacggggagccgcagcagctccccctcccccactgccataaaacattaagaaaatcatattgcttcttctcctatgtgtaaggtgaaccacgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttatcaaagagagggctttaatttttttaaccaaaggtgaaggaatatatggcagagttgtaaatatataaatatatatatatataaaataaatatatataaacctaaaaaagatatattaaaaatataaaactgcgtcaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaaacaaaaagaacaaaaaaatctgcagaaggaaaaacgtgtaattttgttctagttttcagtttgtatataccggtacaacgtgtcctcacggtgccttttttcacggaagtgttcaatgacgggcgagcgtgtgccatcccgttttgaagtgtaggcagacacagggacttgaagttgttactaactaaactctctttgggaatgtgtgtctcatcccattctgcgtcatgcttgtgttgttactactccggagacagggtttggctgtgtctaaactgcatcaccgcgttgtaaaatatagctgtacaaatatcagaataaaatgctgaaaagtcaa

SEQ ID NO: 20 - protein, 706 aa, Chlorocebus sabaeus
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVPAIKPRHEEFLNSRMLMPQDIMAYRGREVVENNLPLRNAPGCESRAFAPSLYSGLSTPPASYSMYSHLPVSSLLFSDEEFRDVRMPVANPFPKERALPCDSTRPVPGEYSRPALEVSPSVCHSNIYSPKETVPEEARSDMHYSVAEGLKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSLTGSPRSSSESHSPLYMHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 21 - DNA, 3560 bp, Chlorocebus sabaeus
  CDS (361)..(2481)
cgtcatgggtccggggagggagagccacattcaggcccctcgaacctcgaacgggaacctccaaatccgagacattctccttatgaggccctcgaaatatgccggacagtgaaaaactcttgtggctttgagggcttttgatcggccaggggaggtaaaaagctcagagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgcatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatcttcacagaccagttgaaatgcaaccttagtgtgatcaatctagatcctgagatcaaccctgagggcttctgcatcctcctggactttatgtacacatctcggctcaatttgcgggagggcaacatcatggctgtgatggccacagctatgtacttgcagatggagcatgttgtggacacctgccggaagtttatcaaggccagtgaagcagagatggttcctgccatcaagccccgtcacgaagagttcctcaacagccgcatgctgatgcctcaagacatcatggcctatcggggtcgtgaggtggtggagaacaacctgccactgaggaacgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggccctgccgtgcgatagtaccaggccagtccccggtgagtacagccggccggccttggaggtgtcccccagtgtgtgccacagcaatatctattcacccaaggaaacagtcccagaagaggcacgaagcgatatgcactacagtgtggctgagggcctcaagcctgctgccccctcagcccgaaatgccccctacttcccctgtgacaaggccagcaaagaagaagagagaccctcctcagaagatgagattgccctgcatttcgagccccccaatgcacccctgaaccggaagggtctggttagtccacagagcccccagaaatctgactgccagcccaactcgcccacagaatcctgcagcagtaagaatgcctgcatcctccaggcctctggctcccctccagccaagagccccactgaccccaaagcctgcaactggaagaaatacaagttcatcgtgctcaacagcctcaaccagaatgccaaaccagaggggccagagcaggctgagctgggccgcctttccccacgagcctacactgccccacctgcctgccagccacctatggagcctgagaaccttgacctccagtccccaaccaagctcagtgccagcggggaggactccaccatcccgcaagccagccggctcaataacatcgttaacaggtccctgacaggctctccccgcagcagcagtgagagccactcaccactctacatgcaccccccgaagtgcacgtcctgcggctctcagtccccacagcatgcagagatgtgcctccacaccgccggccccacgttccctgaggagatgggagagacccagtctgagtactcagattccagctgtgagaacggggccttcttctgcaatgagtgtgactgccgcttctctgaggaggcctcactcaagaggcacacgctgcagacccacagtgacaaaccctacaagtgtgatcgctgccaggcctccttccgctacaagggcaacctcgccagccacaagaccgtccatacgggtgagaaaccgtatcgctgcaacatctgtggggcccagttcaaccgaccagccaacctgaaaacccacactcgaatccactctggagagaagccctacaaatgcgaaacctgtggagccagatttgtacaggtggcgcacctccgtgcccacgtgctcatccacactggtgagaagccctatccctgtgaaatctgtggcacccgtttccggcaccttcagactctgaagagccatctgcgaatccacacgggagagaaaccttaccattgtgagaagtgtaacctgcatttccgtcacaaaagccagctgcgacttcacttgcgccagaagcatggtgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggtggggggtggtgggggtcggggcctgggggacggggagccgcagcagctccccctcccccactgccataaaacattaagaaaatcatattgcttcttctcctatgtgtaaggtgaaccacgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttatcaaagagagggctttaatttttttaaccaaaggtgaaggaatatatggcagagttgtaaatatataaatatatatatatataaaataaatatatataaacctaaaaaagatatattaaaaatataaaactgcgtcaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaaacaaaaagaacaaaaaaatctgcagaaggaaaaacgtgtaattttgttctagttttcagtttgtatataccggtacaacgtgtcctcacggtgccttttttcacggaagtgttcaatgacgggcgagcgtgtgccatcccgttttgaagtgtaggcagacacagggacttgaagttgttactaactaaactctctttgggaatgtgtgtctcatcccattctgcgtcatgcttgtgttgttactactccggagacagggtttggctgtgtctaaactgcatcaccgcgttgtaaaatatagctgtacaaatatcagaataaaatgctgaaaagtcaa

SEQ ID NO: 22 - protein, 706 aa, Chlorocebus sabaeus; identical to SEQ ID NO: 20

SEQ ID NO: 23 - DNA, 9481 bp, Chlorocebus sabaeus
  CDS (6282)..(8402)
aggggggggcgggcagcaagagctaggggccaccccgctgccggatgtagtgaccgtggtaaatgtcttgagaactgtgggttgcgttgcctttatgatgccgtgttattggaaccctggcgaaaaaatggaactagtgttgtaataatgagttttaaagctgccccatggaaaacaaaaacacaaccaaaccgattttttaaaaaaatgaaaaaagaccctctgtgttgtgttcccttctacgatggttgagttggtggctggggtttgggggtggggggtcctgacagttgagccgataaatgaccccaaaccaggtgctgaaagtcccaagctgttacagggcccctgaccacctcaaagagccaatctccactccaccgccccccgcccccgccaccccacaacccgccaggatttaatcttttatggatttttttttcaatcagtttatagtttccaggaggaaagtcttgtaacgctttactttttctcttctttttttaaagtaaagtgagtgtcagtagatgtgttttttacagtctggattaaaaaaaagtggggcaggagagagggaaccagggaaagggctgtttagaaatacagtttgtggctctgagcgatgccaccggcttcctctacagagactgccagtttccctttttctttgcaaggtgtgtgtggttttaataaataactttaaaaaaaagagggggcggcaagatccatcaggagacaggtatctattttgctcactatttactaccaagagcctttggcactagaacagaacctcgtaaatctgcagcccaagttgaagttcatctggccctagtccacacgctattcctggaggtagcaaacatgagctcaaaggagagagatgaaatcacattcttgctttaaaatacatacttttttaaaaaagacgaaaaggtgtttatctctgggggaggaggaaatggcgaacaagtaccagggcattcgcttactctaatgactgcagttgagtcttcaggccaaaatagaaacctgtagatgggagctctctctccacctccgccccgcccccccgcgcaccgccaccccaagtttataaatagaagtttccagtatcctcagtatcctatttggaagactttccaatactagagactgaagcattggctagttttaagggtgtgttggtagggacagtaaggctagatgctgttcatgaaaactagggacttgaaggagacagctagacaaagtgggaattctccaattgtcccttttcttttcagttttgaagggttttattccaatgctttcttgaaaagactaacttattctcggtttggtggataggaatgggactctaaattcttaagttgtcgtttgctgagcccttgaagagttccagttattggttgagtaaatggtagccatggctagatgtcaaaacccttccttccctctatcccctacagggtaatgacactcacaacccactttgttgtgaaaaacttagagatttagaggaggcggtgcagcagcgccacccctcggtgggtgaaactattggcaaaagtcaatttttgaaaaatattgggaagtgaacttatgaaacattttttcccccagagatttaaaaaaaaaagggggggggataaaactaacggataaaaaggactttgcagtttatcaagtagggaagaaaaatgttgctttccaactaggatggtgttataataggcaacgtggttcatatatatatatatatatatatatatatatatatatatatttggtggggggagggtcactggttgactttaagtagaagagttctccaggcggaggtagcccgaccttccccttggactgacttctcagggcatcttaattttgctgcctgtcggataccgagatagtgagggatgtttaggtgtaaaacaccacagtggctggaaatgctgtagttttgccggcggtggcaggacgtatgtgtagggggtgtgttgaggaggtttgtggatggcgtggagcaatggtaggctggtctgtagccctctgtgagtcaacatcgaatggcgcgtgccggtttccatcactgcgcaacaagtgggaccgccactgccgccgcgagcacagcgagggtgcagcgtagtggtaaaactggctggtttctctttgccccagtggaagccaggaacggcccccccaaccctcccgagacccacaacttcaccaaaagaccttacccgactccccactcccccgctttgccagccgcagtgagcctgagtgggatccagctctcggcccccagcgcccctttcctccgagaagatcaggagtttattcccgactttctttgctggacgaccagtgtttggcaagaatatgtgccaatgccgtcgagtgccattctgctttttgaagacaagtgcaccttctttcccttcccagtacataaagcttttcgggagatgggagggggggaaatcaacttatgatacatgaaaccagcccccagataccacgttgcggttgctacaggcgggagcatggggaagaacggaatgccatccactaaattaaatgttttctagctttgcttttagaggcaatcacacccccaaccctcgcccccaccagacagaaaataaagagggacgggtagggatcggtgtggaagttgcggccgcgcggcgattctcggacgggctggcctgccacctagcggtgggctgagatcgagttcgcggccatgggcggtgggctcgctgttccacctctcgggcggcggtgccctgaccagatgctaggactgacagaaggagggcaccctccaatggggatggcatgcaacctccaaagttttgacaagagggatgaaaaatcagaaaggcctcgctgcttgcccatcactcagcgatgagcatctatttccactaaaagaaaccacaaataacccgcttcgaacacaccatcttcctgtccctgtggcccttcttaggggaagtcggtagtggaaggatgccatctaggagctcaggggctttgggacgtacaactctgttttacagttgaggaaacaggcccaacaaggaggcttgttagtggtgagttagtgtcttaaccaggaccagattttaagcttctgaatttcatgtcagtgactgaaagtcacaggcgggtttatctcagctcctttgaagtatttatgagaatggatcggcagccagaaccatgagcttaacctcttaggccacctttgttgccagtgctcattggaaaccgctccgcagcagtcttggaggattttttttttttttttaagaaaatatggcctaagattttcggtaatagacaagaaaagcctagatggtgctgaggggtgtgggtctcggagctcgtgggtttgcgtgttaagatggggattaaggcctgggccaaagacttgcttggcgagcctcgatcctgaaatcgctcccttccccttcctaacatccattgcatagtagcctggcgagaaaccgtgtgtgtgtgtgtgtgtgtgtgtgtgtgtgtgtgtgtgtgtgtgagagagagagagagagagagagagagagagagagagagagagagagagagagagagggagagagggtgggggtcatgtggataggccagaatttgtgccgcaacagctcctccgtaaagttttctttctccgagctcgtgacttaagatggcaaacgcgcgtccgcatgctggcggcccctagcggcagccggcgcgctctgcagcgggagacgcgccgtgtcccccgcccaggtccgcggggatcgaattcagcctctcccactgcgggagccgtccgaggccgcgtcggagaaacgcgcctctgttcgggctggaaacgaatctgggaacgtgtttgaagcgcggtcaagtttgactcatcgctttccaaggacagttagtgccttccatcttcattaacgtgaataaggaccttggctgacttctttccagatcggatttttaaaggcattgtttgcttgaggagatcatgcttctcccctcccccgccagcccttttgcaaaggctgagcccagtccagcccggacggccgagggatctctgctccgggacgcgatttgctggcattgtcttcgggcccttctggaaggctgtctcgcgctgagcgtatggggaacgtcccttttgcaactcctcttcagatcttgatgataaaacacatccctctgttttattgcatttcctagaagcttgcaggcttgcaagagcactttggcaggaaacgtgatagaaatgaaagtcaggacataatgtccccgaacacctcggttatccaaagcggctgccgaggccatcgcgttatcaaattcgcttttatccactgtcgcctcctgtaccctcccgtcccccagccaagagggcgaagagtgtcttcccccaagaataaaagcaactccgccgtttgacctcacccctgccgccggaccacggtggtgtctgcagctgtgcagctagttggctgagacaccgctgagaccgggagccccacggcagggcccctgatgcggggttcactacggcagttccagccttattaaaattccttatccttgtccctaaacagtgctttacactttcaaatttccctttggatttttcagcgggttattggagtcattagattaccaataatccaacagccggcctggctagagaggagggggaagggcggaaggcattctccaaatcgggaggctctggccaaactaggtcaatgggaaggaggggaggggcgagaaaggggttgacggtttcaaaccttgatggagggctctctctagtgttaggcagcggtaaaaacaccattaggtttgagctcccggaaccacgggactcctaatttccaataaatgcacttacttaattttaacttcccagattctcatctctaccccatattaaatcccaaccgtctctttcacctttatcctaccgggcgaaggggtgagaaagcctcagtgtaggattttgagaccaaagaggctccgtctttgcagaccgactctgacccttccgctgccgcagaagggatgagcggcgcagtgtgacgccactggctagttttaggatcagactgcggcctttgtggctgagtctttcactgtcccctgacccccgaaagcgcaccccggagcctgctaccgaggccaattaggacatggcacccgggagggccacaggaaggcgaggcaactttggagagtgccagtgcgtgcgcaggggtcggggccccggcctctgccgagtccaagcagtgtctctacggtttcggggaaatcggtttcggaaatccttacagcttggcagctcctattctaaagactttgggcggaaaccaaggggagctgggttcccgttcttgccaacgtaggcggaaggggctttcgatttagtttttctccaaccttgccaggggcgcctatgatggagaccctcagcccctagggactccatctttttgaccttgaagtctcgcccaaacattcccctaaaagaaaggcggtgagggagaatggaaggcaaaaagagggaaaaaagcaaataaacttcggaatcggacaacttaaagtctcgatatgagcctcggattgtattcgaactcctgggttctagacccagctctgctactaacttgtctgaccttccctatttataaatggttgcgggtgagaggttggactaggtgaactctgagagccctgcactcggcgcggacgagggatttaggggaaagtgtgctgtattccccgcgagccttccccggcggccccgcctccccgggtgaatccccggcggccggcacagcgcaggcagcgatcctggcggctgcccgggcccggcagcttcctggaaagttacttcttgttggagccggcgataggcaaagtgtgttctgtgaaatccgcagagccgagattgactacgttccgggaatgagagggctgtgccattcccctcattgcccgctgccttgacagcgtaacaggggaaaaaaaaaaaaaaggcatacacacaatgttagctaccgaggtgcacgaaaggttttatttgaatgtaactaaattaagggccgccacggtcataccacaaagcctccgtcgcgccttgcggggggcttcgaggtggatcgcccaggggcgggcagtccctggaagacaggttttgagcaaaattttggactgtgaagcaaggcattggtgaagacaaaatggcctcgccggctgacagctgcatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatcttcacagaccagttgaaatgcaaccttagtgtgatcaatctagatcctgagatcaaccctgagggcttctgcatcctcctggactttatgtacacatctcggctcaatttgcgggagggcaacatcatggctgtgatggccacagctatgtacttgcagatggagcatgttgtggacacctgccggaagtttatcaaggccagtgaagcagagatggttcctgccatcaagccccgtcacgaagagttcctcaacagccgcatgctgatgcctcaagacatcatggcctatcggggtcgtgaggtggtggagaacaacctgccactgaggaacgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggccctgccgtgcgatagtaccaggccagtccccggtgagtacagccggccggccttggaggtgtcccccagtgtgtgccacagcaatatctattcacccaaggaaacagtcccagaagaggcacgaagcgatatgcactacagtgtggctgagggcctcaagcctgctgccccctcagcccgaaatgccccctacttcccctgtgacaaggccagcaaagaagaagagagaccctcctcagaagatgagattgccctgcatttcgagccccccaatgcacccctgaaccggaagggtctggttagtccacagagcccccagaaatctgactgccagcccaactcgcccacagaatcctgcagcagtaagaatgcctgcatcctccaggcctctggctcccctccagccaagagccccactgaccccaaagcctgcaactggaagaaatacaagttcatcgtgctcaacagcctcaaccagaatgccaaaccagaggggccagagcaggctgagctgggccgcctttccccacgagcctacactgccccacctgcctgccagccacctatggagcctgagaaccttgacctccagtccccaaccaagctcagtgccagcggggaggactccaccatcccgcaagccagccggctcaataacatcgttaacaggtccctgacaggctctccccgcagcagcagtgagagccactcaccactctacatgcaccccccgaagtgcacgtcctgcggctctcagtccccacagcatgcagagatgtgcctccacaccgccggccccacgttccctgaggagatgggagagacccagtctgagtactcagattccagctgtgagaacggggccttcttctgcaatgagtgtgactgccgcttctctgaggaggcctcactcaagaggcacacgctgcagacccacagtgacaaaccctacaagtgtgatcgctgccaggcctccttccgctacaagggcaacctcgccagccacaagaccgtccatacgggtgagaaaccgtatcgctgcaacatctgtggggcccagttcaaccgaccagccaacctgaaaacccacactcgaatccactctggagagaagccctacaaatgcgaaacctgtggagccagatttgtacaggtggcgcacctccgtgcccacgtgctcatccacactggtgagaagccctatccctgtgaaatctgtggcacccgtttccggcaccttcagactctgaagagccatctgcgaatccacacgggagagaaaccttaccattgtgagaagtgtaacctgcatttccgtcacaaaagccagctgcgacttcacttgcgccagaagcatggtgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggtggggggtggtgggggtcggggcctgggggacggggagccgcagcagctccccctcccccactgccataaaacattaagaaaatcatattgcttcttctcctatgtgtaaggtgaaccacgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttatcaaagagagggctttaatttttttaaccaaaggtgaaggaatatatggcagagttgtaaatatataaatatatatatatataaaataaatatatataaacctaaaaaagatatattaaaaatataaaactgcgtcaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaaacaaaaagaacaaaaaaatctgcagaaggaaaaacgtgtaattttgttctagttttcagtttgtatataccggtacaacgtgtcctcacggtgccttttttcacggaagtgttcaatgacgggcgagcgtgtgccatcccgttttgaagtgtaggcagacacagggacttgaagttgttactaactaaactctctttgggaatgtgtgtctcatcccattctgcgtcatgcttgtgttgttactactccggagacagggtttggctgtgtctaaactgcatcaccgcgttgtaaaatatagctgtacaaatatcagaataaaatgctgaaaagtcaa

SEQ ID NO: 24 - protein, 706 aa, Chlorocebus sabaeus; identical to SEQ ID NO: 20

SEQ ID NO: 25 - DNA, 3566 bp, Saimiri boliviensis boliviensis
  CDS (366)..(2486)
accatcgtcccgggccccgggagggagagccacaggcaggcccctccagcctcgaacccgaacctccaaatccgagacgctctgctgatgaggacctcgaaatatgccggccggtaaaaaaatcttgtggctctgacggcttttgatcggccaggggaggcaaaaatctcggcgagctgacaccaggtcctcccctgccacgtagcagtggtaaagtccgaagctcaaattccgagaattgagctctgttgattcttagaactggggttcttagaagtggtgatgcaagaagtttctaggaaaggccggacaccaggttttaagcaaaattttggactttgaagcaagacattggtgaagacaaaatggcctcgccggctgacagctgtatccagttcacccgccatgccagtgacgttcttctcaaccttaatcgtctccggagtcgagacatcttgactgatgttgtcattgttgtgagccgtgagcagtttagagcccataaaacagtcctcatggcctgcagtggcctgttctatagcatcttcacagaccagttgaaatgcaaccttagtgtgatcaatttagatcctgagatcaaccccgaggggttctgcatcctcctggactttatgtacacgtctcgactcaatttgcgggagggcaacatcatggccgtaatggccacagctatgtacctgcagatggagcatgttgtggatacttgccggaagttcatcaaggccagtgaagcagagatggttcctgccatcaagcctccccgtgaagagttcctcaacagccggatgctgatgccccaagacattatggcttatcggggccgtgaggtggtggagaacagcctgccgctgaggagtgcccctgggtgtgagagcagagcctttgcccccagcctgtacagtggcctgtccacaccaccagcctcttaccccatgtacagccacctccccgtcagcagcttcctcttctccgatgaggagcttcgagatgtccgcatgcctgtggccaaccccttccccaaggagcgggccctcccgtgcgacagtgccaggccagtccccggtgagtacagccggctggccttagaggagtcccctggcgtgtgccatggcaatatctattcgcccaaggaaacagtcccagaagaggcacgaagtgacatgcactacggtgtggccgagggacccaagcctgctgccccctcagcccgaaacgccccctacttcccctgtgacaaggccagcaaagaagaagagagaccctcctcagaagatgagattgccttgcatttcgagccccccaatgcgcccctgaaccggaagggtctggtgagtccacagagcccccagaaatctgactgccagcccaactcgcctacagagtcctgcagcagtaagaatgcctgcatcctccaggcctctggctcccctccagccaagagccccactgaccccaaagcctgcaactggaagaaatacaagttcatcgtgctcaacagcctcaaccagaatgccaaaccagaagggccagagcaggctgagctgggccgcctttccccacgagcctacaccgccccgcctgtctgccagccacccatggagcctgagaaccttgacctccagtccccaaccaagctcagcgccagcggggaggactccaccatcccacaagccagccggctcaataacatcgttaacaggtccctgacgggctctccccgcagcagcagtgagagccactcaccgctctacatgcacccgccgaagtgcgcgtcctgtggctctcagtccccacagcatgcagagatgtgcctgcacactgccggacccacgttccccgaggagatgggagagacccagtctgagtactcggattccagctgtgagaacggagccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagactgtccacaccggtgagaaaccctatcgttgcaacatctgtggggcccagttcaaccggccagccaacctgaaaacccacactcgaattcactctggagagaagccctacaaatgcgaaacctgtggagccagatttgtacaggtggcccacctccgtgcccatgtgctcatccacactggcgagaagccctatccctgtgaaatctgtggcacccgtttccggcaccttcagactctgaagagccacctgcgaatccacacgggagagaaaccttaccattgtgagaagtgtaacctgcatttccgtcacaaaagccagctgcgacttcacttgcgccagaagcatggcgccatcaccaacaccaaggtgcaataccgcgtgtcggccacagacctgcctccggagctccccaaagcctgctgaagcatggagtgttgatgctttttcctctccagccccttctcagaatctacccaaaggatactgtaacactttacaatgttcatcccatgatgtagtgcctctttcatccactagtgcaaatcatagctgggggtggggggtgtcgggggtcggggcctgggggattgggagtcacggcagctccccctcccccactgccataaaacattaagaaaataatattgcttcttctcctatgtgtaaggtgaaccacgtcagcaaaaagcaaaatcattttctatgtcaaagcggggagtatgcaaaaagttctgacttgactttagtctgcaaaatgaggaatgtatatgtttcgtgggaacagatgtttcttttgtatgtaaatgtgcattcttttaaaagacaagacttcggtatgttataaaagagagggctttaatttttttaaccaaaggtgaaggaatatatggcagagctgtaaatatataaatatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaaaaaaagaacaaaaaaacccgcagaaggaaaacgtgtaattttgttctagttttcagtttgtatatacctgtacaacgtgtcctcacggtgccttttttcatggaagttttcaatgatgggcgagcgtgcgccattccgttttgaagcgtaggcagacacagggacttgaagttgttactaactaaactctctttgggaacgtttgtctcatcccattctgcgtcatgcttgtgttataactactccggagacagggtttggctgtgtctaaactgcattaccgcgttgtaaaatatagctgtacaaatataagaataaaatgttgaaaagtcaa

SEQ ID NO: 26 - protein, 706 aa, Saimiri boliviensis boliviensis
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVPAIKPPREEFLNSRMLMPQDIMAYRGREVVENSLPLRSAPGCESRAFAPSLYSGLSTPPASYPMYSHLPVSSFLFSDEELRDVRMPVANPFPKERALPCDSARPVPGEYSRLALEESPGVCHGNIYSPKETVPEEARSDMHYGVAEGPKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPVCQPPMEPENLDLQSPTKLSASGEDSTIPQASRLNNIVNRSLTGSPRSSSESHSPLYMHPPKCASCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 27 - DNA, 3272 bp, Saimiri boliviensis boliviensis
  CDS (72)..(2192)
ggaattgaaaaaagattgagaggttttaagcaaaattttggactttgaagcaagacattggtgaagacaaaatggcctcgccggctgacagctgtatccagttcacccgccatgccagtgacgttcttctcaaccttaatcgtctccggagtcgagacatcttgactgatgttgtcattgttgtgagccgtgagcagtttagagcccataaaacagtcctcatggcctgcagtggcctgttctatagcatcttcacagaccagttgaaatgcaaccttagtgtgatcaatttagatcctgagatcaaccccgaggggttctgcatcctcctggactttatgtacacgtctcgactcaatttgcgggagggcaacatcatggccgtaatggccacagctatgtacctgcagatggagcatgttgtggatacttgccggaagttcatcaaggccagtgaagcagagatggttcctgccatcaagcctccccgtgaagagttcctcaacagccggatgctgatgccccaagacattatggcttatcggggccgtgaggtggtggagaacagcctgccgctgaggagtgcccctgggtgtgagagcagagcctttgcccccagcctgtacagtggcctgtccacaccaccagcctcttaccccatgtacagccacctccccgtcagcagcttcctcttctccgatgaggagcttcgagatgtccgcatgcctgtggccaaccccttccccaaggagcgggccctcccgtgcgacagtgccaggccagtccccggtgagtacagccggctggccttagaggagtcccctggcgtgtgccatggcaatatctattcgcccaaggaaacagtcccagaagaggcacgaagtgacatgcactacggtgtggccgagggacccaagcctgctgccccctcagcccgaaacgccccctacttcccctgtgacaaggccagcaaagaagaagagagaccctcctcagaagatgagattgccttgcatttcgagccccccaatgcgcccctgaaccggaagggtctggtgagtccacagagcccccagaaatctgactgccagcccaactcgcctacagagtcctgcagcagtaagaatgcctgcatcctccaggcctctggctcccctccagccaagagccccactgaccccaaagcctgcaactggaagaaatacaagttcatcgtgctcaacagcctcaaccagaatgccaaaccagaagggccagagcaggctgagctgggccgcctttccccacgagcctacaccgccccgcctgtctgccagccacccatggagcctgagaaccttgacctccagtccccaaccaagctcagcgccagcggggaggactccaccatcccacaagccagccggctcaataacatcgttaacaggtccctgacgggctctccccgcagcagcagtgagagccactcaccgctctacatgcacccgccgaagtgcgcgtcctgtggctctcagtccccacagcatgcagagatgtgcctgcacactgccggacccacgttccccgaggagatgggagagacccagtctgagtactcggattccagctgtgagaacggagccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagactgtccacaccggtgagaaaccctatcgttgcaacatctgtggggcccagttcaaccggccagccaacctgaaaacccacactcgaattcactctggagagaagccctacaaatgcgaaacctgtggagccagatttgtacaggtggcccacctccgtgcccatgtgctcatccacactggcgagaagccctatccctgtgaaatctgtggcacccgtttccggcaccttcagactctgaagagccacctgcgaatccacacgggagagaaaccttaccattgtgagaagtgtaacctgcatttccgtcacaaaagccagctgcgacttcacttgcgccagaagcatggcgccatcaccaacaccaaggtgcaataccgcgtgtcggccacagacctgcctccggagctccccaaagcctgctgaagcatggagtgttgatgctttttcctctccagccccttctcagaatctacccaaaggatactgtaacactttacaatgttcatcccatgatgtagtgcctctttcatccactagtgcaaatcatagctgggggtggggggtgtcgggggtcggggcctgggggattgggagtcacggcagctccccctcccccactgccataaaacattaagaaaataatattgcttcttctcctatgtgtaaggtgaaccacgtcagcaaaaagcaaaatcattttctatgtcaaagcggggagtatgcaaaaagttctgacttgactttagtctgcaaaatgaggaatgtatatgtttcgtgggaacagatgtttcttttgtatgtaaatgtgcattcttttaaaagacaagacttcggtatgttataaaagagagggctttaatttttttaaccaaaggtgaaggaatatatggcagagctgtaaatatataaatatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaaaaaaagaacaaaaaaacccgcagaaggaaaacgtgtaattttgttctagttttcagtttgtatatacctgtacaacgtgtcctcacggtgccttttttcatggaagttttcaatgatgggcgagcgtgcgccattccgttttgaagcgtaggcagacacagggacttgaagttgttactaactaaactctctttgggaacgtttgtctcatcccattctgcgtcatgcttgtgttataactactccggagacagggtttggctgtgtctaaactgcattaccgcgttgtaaaatatagctgtacaaatataagaataaaatgttgaaaagtcaa

SEQ ID NO: 28 - protein, 706 aa, Saimiri boliviensis boliviensis; identical to SEQ ID NO: 26

SEQ ID NO: 29 - DNA, 7777 bp, Saimiri boliviensis boliviensis
  CDS (4577)..(6697)
tttcatgccagtgtctgagagtcaaaggcgggttgatctcagctcctttgaagtatccacgagaaaggagcgacggccagaaccaggagtccaacctcttaggatgccttgtttgtcagcagtcattggaaaccgttccccagcagtcctggaggaattgtttttttttttttttttttttttttttaaagaaaatatggcttcagattttcggtaataggaaaagcccagatggtgctgaggggtgggggtctcgagctcgggggttcgcgtgttaggcagggtcgggggtgaaggcctgggccaaagacttgcaggggcgagcctcgatcctcacaccgctctcttccccttccttccatcccttgcatggctgcctggcgagaaaccgggtgtgtgtgtgtgaggggccgggggccacgcggactggccagagtccgtgccacaacagcccctccgtaaagttttcttcttccgagctcgtgacttaagatggcaaacgcgcgtccgcaggctggcggcccctagcggcggccggcgcactctgcagcgggaggcggcgccgtcgcccccgcccgggtccgcggggatcgagttcagcctgtcccactgcgggagccgtcggaggccgcgtcggagaaacgcgcctctgttcgggctggaaacgaatctgggaacgtgtttgaagcgcggtcaagtttgactcatcgctttccaaggacagttagtgccttccatcttcattaacgtgaataagaaccttggctgacttctttccagatcgaatttttaaaggcattgtttgcttgaggagatcatgcctctcccctcccccgccagccttttttttttttttttcaaaggctgagcccaatccagccaggatggccgagggatctctgccccgggacgtgatttgctggcactgtcttcgagccgttctggaaggctgtcttgagctgagcgtttggggagcgtcctttctgcaactcctcttcagatcttgatgataaaacacatccttctgttttattgcatttcctagaagcttgcaggcttgtaagagcgctgttggcaggaaacgtgatagaaatgaaagtcaggacatcttgtccccggacacctcggttacctaaagcggctgccgaggccatcgtgttatcaaatttgcttttatccactgtcgcctcccgcaccctcccgtcccccagacaagagggcgaagagtgtttttccctaagaataaaaacaactcagcggtctgacctcaccccctgccgccggaccacagtggtgtctacggccgtgcagagactctacggagaccgggagccccaccgcagggcccctgatgcggggttcactccggcagctccagccttattaaaattccttgtccttgtccctaaacagtgctttacactttcaaattcccctttggatttttcagcgagttattggagttattagattaccaataatccaacagccggcctggctggagagtcggggggaagggcggaaggcattctccaaatcaggaggctctggccaaactaggtcaatgggaaggaggggaggggcgagaaagggctggacggtttcaaaccttgatggagggctctctctagtgttaggcagcggcaaaaacacccttaggtctgagctcccggaaccacgggactcctaattgccaataaatgcacttacttgagtttaacttcccagatgctcatccctaccccatattaaaacccagccttctctttcacctttatccccccgggcgaaggggtgggaaggcctccatgtagaattttgaggccgaagaggctcagcctctgcgcaccgactctgacctttccgctgccgcagaagggctgagcggcgcagcgtggcgccactggctggttttaggacctgactgcggccttggttgctgagtctttcgctgtcccctgacccctaaaagcgcaccccggagcctgctaccgagaccaaataggacagggcatcccggggttatcattcccgggagggccgcgggaagacgaggcaagtgtggagagcgcccgtgtccgcgcaggggtcggggctgggcctctgcccagtccaagccgggtctctacggtttcgggaaaatcgggttcagaaatccttacggcccggcagctcctattctgaagactttgggcggaaaccaagcggagctgggttcccgttcttgccaacgtcggcggaaggggctttcggtttagtttttctccaaccttggctggggcgcctttgatggagaccctcagcagtagggattccatctttttgaccttgaagtctcgccctaacatccccctaaaagaaggggggcgagggagaatggaaggcaaaaagaggaaaaaaagcaaataaacttcggaatcgggcaacttaaagtcacgatatgagcctcggattggattccaactcctgggttctagtcccagctctgctgctaactgaccttccccgttgataaactgttgtgggtgagaggttggactaggtgaactctgagagccctggacttggcgcagacgagggatttaggggaaagtgtgctgtattccccgcgagccttccccggcggccccgcctccccgggtgaatccccggcggccggcgcagcgcaggcggcgatcctggcggctgccgggcccggcagcttcctggaaagttacttctcgttggagccggcgataggcagagcaggttctgcgaaatccgcagagccgagattgactacgttccgggaatgagagggctgtgccattcccctcattgcctgatgtcttgacggcgtaacaggaaaaaaaaaaaaaaaaaaaaaaaaaaaaaaaaaaaaaaaggcatacacaccatgttagctaccgaggtgcatgaaaagttttatttgaatgtaactaaattaagggccgccacagtcatcccacaaagtctcggtcccgccttgcggggggcttggaggtggatcgcccaggggcgggcagtccctggaagacaggtacggtgtcgtcggggtggggcagtgaggtctgcccaggcttgccccggcccgcagggctcctgtttgtgctcttgtgtgtgaaggagaaaatggggctgcctggtgccagcccaggggaggagggaggaaaagaatggggtctttggtattggctagctctctgcctcttaacatcgcccctggctcttctctcattctctctctctctctctctctctctctctctctctctctctggcttctgctgctgtcttctctctctttgcttttttatttttggttcctgttttcttcttcagtggaaagctcttttaatggatctgccttctcaaggagcctagttggatatgcacaaggaaagctcccaaggagctaaagggaagaagggaggaggaaacaccgagctctcccatggtggttactgagcccgcgggggtgcgggacgttgggatgggaagtccgggtctgggggcggcggctgtcagtttctcattgacagccctgcttttcctcggagattgtttttgcgggtagtcttgtgtgtggcattggcggcagggctgaatctaggagatgcgacctgtccaggacttgctggaaattggctttgagatcttaggcaaggcttctcacctggagcttcagttccctccctgatcaatcggggctgttagaaggatacgatgcaatcgtgaggggtgggaaaggaccgagagctgtgtaccaaagcaaactaaatgctggtggtgcttccacacctgcggcgtctagggtgggggcggtgacggcattgcccacactcaacccccaggctcaggagttggggggagggcctcttaagaagagctggcttacaaaggagtgagcttgataaggacctgcgccttgtgtgtgtctatttatttgcttttggtcaggcagaggcttaaggtgaaaagcccaagtcccaactgaccgtggacacaggggaacttgtttgtttgtttcattctgcatctggagtgagtcatggccacttgtcatggtgaaatggcaaatctgggcttcctgtggttccagaagcctgtgcctggaaatccacaagcgagctggtggttgaagctggttaaagaacagcctaggtattccagaagtgtttgaggatcgcttccatgagggaagagaggcaagtttataagtaaacctcccatgtgtcttcagctttcttttgtgaaggagaaaatctttgcagtttggttaagaccgagttagtatagctgtcttggcctatcctgagttggatggggagaggaggggataggttctttggtctttttctgtcctctcctttccccacttccttccccgcagcccccacttgctcacatgcacacactaaccttggagccgatgggattgagtgactggcacttgggaccacagagaaatgtcagagtgtttggttacagactcaaggaaacctctcattttagagtgctcatttggttttaagcaaaattttggactttgaagcaagacattggtgaagacaaaatggcctcgccggctgacagctgtatccagttcacccgccatgccagtgacgttcttctcaaccttaatcgtctccggagtcgagacatcttgactgatgttgtcattgttgtgagccgtgagcagtttagagcccataaaacagtcctcatggcctgcagtggcctgttctatagcatcttcacagaccagttgaaatgcaaccttagtgtgatcaatttagatcctgagatcaaccccgaggggttctgcatcctcctggactttatgtacacgtctcgactcaatttgcgggagggcaacatcatggccgtaatggccacagctatgtacctgcagatggagcatgttgtggatacttgccggaagttcatcaaggccagtgaagcagagatggttcctgccatcaagcctccccgtgaagagttcctcaacagccggatgctgatgccccaagacattatggcttatcggggccgtgaggtggtggagaacagcctgccgctgaggagtgcccctgggtgtgagagcagagcctttgcccccagcctgtacagtggcctgtccacaccaccagcctcttaccccatgtacagccacctccccgtcagcagcttcctcttctccgatgaggagcttcgagatgtccgcatgcctgtggccaaccccttccccaaggagcgggccctcccgtgcgacagtgccaggccagtccccggtgagtacagccggctggccttagaggagtcccctggcgtgtgccatggcaatatctattcgcccaaggaaacagtcccagaagaggcacgaagtgacatgcactacggtgtggccgagggacccaagcctgctgccccctcagcccgaaacgccccctacttcccctgtgacaaggccagcaaagaagaagagagaccctcctcagaagatgagattgccttgcatttcgagccccccaatgcgcccctgaaccggaagggtctggtgagtccacagagcccccagaaatctgactgccagcccaactcgcctacagagtcctgcagcagtaagaatgcctgcatcctccaggcctctggctcccctccagccaagagccccactgaccccaaagcctgcaactggaagaaatacaagttcatcgtgctcaacagcctcaaccagaatgccaaaccagaagggccagagcaggctgagctgggccgcctttccccacgagcctacaccgccccgcctgtctgccagccacccatggagcctgagaaccttgacctccagtccccaaccaagctcagcgccagcggggaggactccaccatcccacaagccagccggctcaataacatcgttaacaggtccctgacgggctctccccgcagcagcagtgagagccactcaccgctctacatgcacccgccgaagtgcgcgtcctgtggctctcagtccccacagcatgcagagatgtgcctgcacactgccggacccacgttccccgaggagatgggagagacccagtctgagtactcggattccagctgtgagaacggagccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagactgtccacaccggtgagaaaccctatcgttgcaacatctgtggggcccagttcaaccggccagccaacctgaaaacccacactcgaattcactctggagagaagccctacaaatgcgaaacctgtggagccagatttgtacaggtggcccacctccgtgcccatgtgctcatccacactggcgagaagccctatccctgtgaaatctgtggcacccgtttccggcaccttcagactctgaagagccacctgcgaatccacacgggagagaaaccttaccattgtgagaagtgtaacctgcatttccgtcacaaaagccagctgcgacttcacttgcgccagaagcatggcgccatcaccaacaccaaggtgcaataccgcgtgtcggccacagacctgcctccggagctccccaaagcctgctgaagcatggagtgttgatgctttttcctctccagccccttctcagaatctacccaaaggatactgtaacactttacaatgttcatcccatgatgtagtgcctctttcatccactagtgcaaatcatagctgggggtggggggtgtcgggggtcggggcctgggggattgggagtcacggcagctccccctcccccactgccataaaacattaagaaaataatattgcttcttctcctatgtgtaaggtgaaccacgtcagcaaaaagcaaaatcattttctatgtcaaagcggggagtatgcaaaaagttctgacttgactttagtctgcaaaatgaggaatgtatatgtttcgtgggaacagatgtttcttttgtatgtaaatgtgcattcttttaaaagacaagacttcggtatgttataaaagagagggctttaatttttttaaccaaaggtgaaggaatatatggcagagctgtaaatatataaatatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaaaaaaagaacaaaaaaacccgcagaaggaaaacgtgtaattttgttctagttttcagtttgtatatacctgtacaacgtgtcctcacggtgccttttttcatggaagttttcaatgatgggcgagcgtgcgccattccgttttgaagcgtaggcagacacagggacttgaagttgttactaactaaactctctttgggaacgtttgtctcatcccattctgcgtcatgcttgtgttataactactccggagacagggtttggctgtgtctaaactgcattaccgcgttgtaaaatatagctgtacaaatataagaataaaatgttgaaaagtcaa

SEQ ID NO: 30 - protein, 706 aa, Saimiri boliviensis boliviensis; identical to SEQ ID NO: 26

SEQ ID NO: 31 - DNA, 2985 bp, Pongo abelii
  CDS (109)..(2229)
agaactggggttcttagaagtggtgatgcaagaagtttctaggaaaggccggacaccaggttttgagcaaaattttggactgtgaagcaaggcattggtgaagacaaaatggcctcaccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgaggggttctgcatcctcctggactttatgtacacatctcggctcaatttgcgggagggcaacatcatggctgtgatggccacagctatgtacctgcagatggagcatgttgtggacacttgccggaagtttatcaaggccagtgaagcagagatggttcctaccatcaagccccctcgtgaagagttcctcaacagccggatgctgatgccgcaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggccctcccatgtgatagtgccaggccagtccctggtgagtacagccggccgactttggaggtgtcccccaatgtgtgtcacagcaatatctattcacccaaggaaacagtcccagaagaggcacgaagtgatatgcactacagtgtggctgagggcctcaagcctgctgccccctcagcccgaaatgcgccctacttcccttgtgacaaggccagcaaagaagaagagagaccctcctcagaagatgagattgcccttcatttcgagccccccaatgcacccctgaaccggaagggtctggttagtccacagagcccccagaaatctgactgccagcccaactcacccacagagtcctgcagcagtaagaatgcctgcatcccccaggcctctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacactgccccacctgcctgccagccacccatggagcctgagaaccttgacctccagtccccaaccaagctcagtgccagcggggaggactccaccatcccacaagccagccggctcaataacatcgttaacaggtccatgacgggctctccccgcagcagcagcgagagccactcaccactctacatgcaccccccgaagtgcacatcctgcggctctcagtccccacagcatgcagagatgtgcctccacaccgctggccccacgtttcctgaggagatgggagagacccagtctgagtactcagattccagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgtaacatctgtggggcccagttcaaccggccagccaacttgaaaacccacactcgaattcactctggagagaagccctacaaatgcgaaacctgtggagccagatttgtgcaggtggctcacctccgtgcccacgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagtcagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggtggggggtggtgggggtcggggcctgggggactgggagccgcagcaggctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtagatgtgcattcttttaaaagacaagacttcagtatgttatcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaacaaaaaaaaaaaaaaa

SEQ ID NO: 32 - protein, 706 aa, Pongo abelii
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVPTIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCHSNIYSPKETVPEEARSDMHYSVAEGLKPAAPSARNAPYFPCDKASKEEERPSSEDEIALHFEPPNAPLNRKGLVSPQSPQKSDCQPNSPTESCSSKNACIPQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 33 - DNA, 2906 bp, Gorilla gorilla gorilla
  CDS (657)..(2777)
attttattttttttctcttactcgcctctctaaccctactatatatataaaacatacttttcccagtggttcaaacctctcgctcccttttgtgcatttagctcgatctgctgagtttatgggtaagaaagaaggaattagccccagaccccgggaaagcaaagcgcactccccctcttatgtcaccgaatagcaaattagttctcagaattccagaggccgagctttgctacagcgaaggcgccgacgtcacagaggaggagcccacgtgacggtggcggagcaggccataccatcgtcttgggcccggggagggagagccaccttcaggcccctcgagcctcgaaccggaacctccaaatccgagacgctctgcttatgaggacctcgaaatatgccggccagtgaaaaaatcttgtggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgaggggttctgcatcctcctggactttatgtacacatctcggctcaatttgcgggagggcaacatcatggctgtgatggccacggctatgtacctgcagatggagcatgttgtggacacttgccggaagtttatcaaggccagtgaagcagagatggttcctgccatcaagccccctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagttcctggtgagtacagccggccgactttggaggtgtcccccaatgtgtgccacagcaatatctattcacccaaggaaacagtcccagaagaggcacgaagtgatatgcactacagtgtggctgagggcctcaagcctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctcagtgccagcggggaggactccaccatcccacaagccagccggctcaataacatcgttaacaggtccatgacgggctctccccgcagcagcagcgagagccactcaccactctacatgcaccccccaaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccacgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctggg

SEQ ID NO: 34 - protein, 706 aa, Gorilla gorilla gorilla; identical to SEQ ID NO: 8

SEQ ID NO: 35 - DNA, 3563 bp, Orcinus orca
  CDS (366)..(2486)
accatcgtccgggggccggggagggagagccaccgtctggcccctcgagcctcacaccgaaacctccaaacccgagacgcccagcctgtgaggaacccgaaatatgccggacagtgggaaaatattgtggctttgagggttttttatgggccaaagcaggcaaaagtcgcggagagctgacaccgagtcctcccctgccacgtagcagtggtaaggcccgcagctcaaattccgagaattgagctctgttgattcttagaactggggttcttagaagtggtgatgcaagaagtttctaggaaaggccggacaccaggttttaagcaaaattttggactgtgaatcaaggcattgggtaaaaaaaaatggcctcgccggctgacagctgtatccagttcacccgccacgccagtgacgttcttctcaaccttaatcgcctccggagccgtgacatcttgacggatgttgtcatagtggtgagccgggagcagttccgagcccataagacggtcctcatggcctgcagtggcctgttctacagcatcttcacagaccagctgaaatgcaacctcagtgtgatcaacctggatcctgagatcaacccggaggggttctgcatcctcctggacttcatgtacacatctcggctcaatctgcgggagggcaacatcatggctgtgatggccacagctatgtacctgcagatggagcatgttgtggacacttgccggaagttcatcaaggccagtgaagcagagatggtccctgccattaagcctccccgtgaagacttcctgaacagccggatgctgatgccccaggacctcatggcctatcggggccgggaggtggtggagaacagcctgcccctgaggaacgcccctgggtgtgagagcagagccttcgcgcccagcctgtacaatggcctgtccacgccgccagcctcgtaccccatgtatggccaccttccggtcagcagcttcctcttctccgacgaggagctgcgggatgcccggatgcctgtggccaactccttccccaaggagcggaccctcccctgcgacagtgccaggccagtccccagtgagtacagtcggccggccatggagctctcccccactgtgggccacaacaacgtgtactcacccaaggaggcagccctggaggaggcacggagtgatatgcactacagtgtggccgagggccccaagcctgctgccccctcggcccggagcgccccgtacttcgcctgtgacaaggccggcaaagaggaagagaggccctcgtcggaggatgagattgccctgcatttcgagccgcccaatgcacccctgaaccggaagggtctggtgagcccgcagagcccccagaagtccgactgccaacccaactcacccacggagtcctgcagcagcaagaacgcctgcatcctccagacctccgggtcccctccggccaaaagccccactgaccccaaagcctgcaactggaagaagtacaagttcatcgtgctcaacagcctcaaccagaatgccaaaccagaggggcccgagcaggccgagctgggccgcctttcccctcgagcctacactgccccagcggcctgccagccgcccatggagcccgagacccttgacctccagtccccaaccaagctcagcaccagtggggaggactccaccatcccacaggccagcaggctcaataacatcgtcaacaggtcactgaccggctccccacgcagcagcagtgagagccactctccactctacctgcacgcccccaagtgcacgtcctgtggctctcagtccccgcagcacgcagagatgtgcctccacgccactggtcccacgttccccgaggagctgggagagacccagtctgagtactcagattccagctgtgagaacggggccttcttctgcaatgagtgtgactgccgcttttctgaggaggcctccctcaagaggcatacgctgcagacccacagtgacaaaccctacaagtgtgaccgctgccaggcctcctttcgctacaagggcaacctcgccagccacaagaccgtccacacgggtgagaagccctatcgctgtaacatctgcggggcccagttcaaccggccagccaacctgaaaacccacacccgaattcactccggagagaagccctacaagtgcgaaacgtgcggagccagatttgtccaggtggcccacctccgtgcccacgtgctcatccacactggcgagaagccctatccctgtgaaatctgtggcacccgtttccggcaccttcagactctgaagagccacctgcgaatccacacgggagagaaaccttaccattgtgagaaatgtaacctgcatttccgtcacaaaagccagctgcgtcttcacttgcgccagaagcacggtgccattaccaacaccaaggtgcaataccgtgtgtccgccactgacctgcccccggagctccccaaagcctgctgaagcatggagtgttgatgctttccattcgagccccttctcagaatctacccaaaggatactgtaacactttaccatgttcatcccatgatgtagtgcctctttcatccactagtgcaaatcatagctgggggagtgggggggtgggggaggggggggggggggggggggggcccccccccccccccctcccctcccccactgccgtaaaacattaagaaaataatactgcttcttctcctatgtgtaaggcgaaccatgtcagcaaaaagcaaaatcattttatatatcgaagctgggggagtatgcaaaagttctgacttgactcagtctgcaaaatgaggaatgtatatgttttgtgggatcagatgtttcttttgtatgtaaatgtgcattcttttaaaagaagagacttcggtatgttatcaaagagagggctttaatttttttaaccaaaggtgaaggaatatatggcagagttgtaaatatataaatatatatatatatataaaataaatatatataaacctaaaaaagatatattaaaaatataaaaccgcgttaaaggctcgattttgtatctgcaggcagacacggatctgagaatctttatgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaagaacaaaaaaagctgcggaaggaaaaatgtgtagttttgttctagttttcggtttgtatatacctgtacaacgtgtcctacggtgcctttttttcatggaagttttcagtgggcaacgaccgcaccatcccttttggaagtgtaggcagacacagggacttggagttatcactaactaagctctctttgggaatgtttgtctcatcccattctgcgtcatgcttgtgttataactactccggagacagggtttggctgtgtctaaactgcattactgagttgtaaaatatagctgtacaaatacaagaataaaatgttgaaaagtcaa

SEQ ID NO: 36 - protein, 706 aa, Orcinus orca
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVPAIKPPREDFLNSRMLMPQDLMAYRGREVVENSLPLRNAPGCESRAFAPSLYNGLSTPPASYPMYGHLPVSSFLFSDEELRDARMPVANSFPKERTLPCDSARPVPSEYSRPAMELSPTVGHNNVYSPKEAALEEARSDMHYSVAEGPKPAAPSARSAPYFACDKAGKEEERPSSEDEIALHFEPPNAPLNRKGLVSPQSPQKSDCQPNSPTESCSSKNACILQTSGSPPAKSPTDPKACNWKKYKFIVLNSLNQNAKPEGPEQAELGRLSPRAYTAPAACQPPMEPETLDLQSPTKLSTSGEDSTIPQASRLNNIVNRSLTGSPRSSSESHSPLYLHAPKCTSCGSQSPQHAEMCLHATGPTFPEELGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 37 - DNA, 3289 bp, Orcinus orca
  CDS (87)..(2207)
ctcaaggaaacctctcattttagagtgctcatttggttttaagcaaaattttggactgtgaatcaaggcattgggtgaagaaaaaaatggcctcgccggctgacagctgtatccagttcacccgccacgccagtgacgttcttctcaaccttaatcgcctccggagccgtgacatcttgacggatgttgtcatagtggtgagccgggagcagttccgagcccataagacggtcctcatggcctgcagtggcctgttctacagcatcttcacagaccagctgaaatgcaacctcagtgtgatcaacctggatcctgagatcaacccggaggggttctgcatcctcctggacttcatgtacacatctcggctcaatctgcgggagggcaacatcatggctgtgatggccacagctatgtacctgcagatggagcatgttgtggacacttgccggaagttcatcaaggccagtgaagcagagatggtccctgccattaagcctccccgtgaagacttcctgaacagccggatgctgatgccccaggacctcatggcctatcggggccgggaggtggtggagaacagcctgcccctgaggaacgcccctgggtgtgagagcagagccttcgcgcccagcctgtacaatggcctgtccacgccgccagcctcgtaccccatgtatggccaccttccggtcagcagcttcctcttctccgacgaggagctgcgggatgcccggatgcctgtggccaactccttccccaaggagcggaccctcccctgcgacagtgccaggccagtccccagtgagtacagtcggccggccatggagctctcccccactgtgggccacaacaacgtgtactcacccaaggaggcagccctggaggaggcacggagtgatatgcactacagtgtggccgagggccccaagcctgctgccccctcggcccggagcgccccgtacttcgcctgtgacaaggccggcaaagaggaagagaggccctcgtcggaggatgagattgccctgcatttcgagccgcccaatgcacccctgaaccggaagggtctggtgagcccgcagagcccccagaagtccgactgccaacccaactcacccacggagtcctgcagcagcaagaacgcctgcatcctccagacctccgggtcccctccggccaaaagccccactgaccccaaagcctgcaactggaagaagtacaagttcatcgtgctcaacagcctcaaccagaatgccaaaccagaggggcccgagcaggccgagctgggccgcctttcccctcgagcctacactgccccagcggcctgccagccgcccatggagcccgagacccttgacctccagtccccaaccaagctcagcaccagtggggaggactccaccatcccacaggccagcaggctcaataacatcgtcaacaggtcactgaccggctccccacgcagcagcagtgagagccactctccactctacctgcacgcccccaagtgcacgtcctgtggctctcagtccccgcagcacgcagagatgtgcctccacgccactggtcccacgttccccgaggagctgggagagacccagtctgagtactcagattccagctgtgagaacggggccttcttctgcaatgagtgtgactgccgcttttctgaggaggcctccctcaagaggcatacgctgcagacccacagtgacaaaccctacaagtgtgaccgctgccaggcctcctttcgctacaagggcaacctcgccagccacaagaccgtccacacgggtgagaagccctatcgctgtaacatctgcggggcccagttcaaccggccagccaacctgaaaacccacacccgaattcactccggagagaagccctacaagtgcgaaacgtgcggagccagatttgtccaggtggcccacctccgtgcccacgtgctcatccacactggcgagaagccctatccctgtgaaatctgtggcacccgtttccggcaccttcagactctgaagagccacctgcgaatccacacgggagagaaaccttaccattgtgagaaatgtaacctgcatttccgtcacaaaagccagctgcgtcttcacttgcgccagaagcacggtgccattaccaacaccaaggtgcaataccgtgtgtccgccactgacctgcccccggagctccccaaagcctgctgaagcatggagtgttgatgctttccattcgagccccttctcagaatctacccaaaggatactgtaacactttaccatgttcatcccatgatgtagtgcctctttcatccactagtgcaaatcatagctgggggagtgggggggtgggggaggggggggggggggggggggggcccccccccccccccctcccctcccccactgccgtaaaacattaagaaaataatactgcttcttctcctatgtgtaaggcgaaccatgtcagcaaaaagcaaaatcattttatatatcgaagctgggggagtatgcaaaagttctgacttgactcagtctgcaaaatgaggaatgtatatgttttgtgggatcagatgtttcttttgtatgtaaatgtgcattcttttaaaagaagagacttcggtatgttatcaaagagagggctttaatttttttaaccaaaggtgaaggaatatatggcagagttgtaaatatataaatatatatatatatataaaataaatatatataaacctaaaaaagatatattaaaaatataaaaccgcgttaaaggctcgattttgtatctgcaggcagacacggatctgagaatctttatgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaagaacaaaaaaagctgcggaaggaaaaatgtgtagttttgttctagttttcggtttgtatatacctgtacaacgtgtcctacggtgcctttttttcatggaagttttcagtgggcaacgaccgcaccatcccttttggaagtgtaggcagacacagggacttggagttatcactaactaagctctctttgggaatgtttgtctcatcccattctgcgtcatgcttgtgttataactactccggagacagggtttggctgtgtctaaactgcattactgagttgtaaaatatagctgtacaaatacaagaataaaatgttgaaaagtcaagtcgg

SEQ ID NO: 38 - protein, 706 aa, Orcinus orca; identical to SEQ ID NO: 36

SEQ ID NO: 39 - DNA, 3323 bp, Canis lupus familiaris
  CDS (135)..(2255)
cgagaattgagctctgttgattcttagaactggggttcttagaagtggtgatgcaagaagtttctaggaaaggccggacaccagattttaagcaaaattttggactgtgaatcaaggcattgggtgaagacaaaatggcctccccggctgacagctgtatccagttcacccgccatgccagtgacgtgcttctcaaccttaatcgcctccgcagccgtgacatcttgactgatgttgtcatcgtggtgagccgtgagcagttcagagcccataagacagtcctcatggcctgcagtggcctgttctacagcatcttcacagaccagttgaaatgtaaccttagtgtgatcaacctggatcctgagatcaaccctgaggggttctgcatcctcctggacttcatgtacacgtctcggctcaatctccgggagggcaacatcatggccgtgatggctacggcgatgtacctgcagatggagcatgtggtggacacctgccggaagtttatcaaggccagtgaagcagagatggttcctgccatcaagcctccccgtgaagagtttctgaatagccggatgctgatgccccaagacatcatggcctatcggggtcgtgaggtggtggagaataacctgccgctgaggaacgcccctgggtgtgagagcagagcctttgcccccagcctgtacagcggcctgtccaccccgccggcctcttatcccgtgtacggccacctcccagtcagcagcttcctcttctccgacgaggagctgcgggatgcccggatgcctgtggccaaccccttccctaaggagcgggccctcccctgcgatagtgccaggcccatccctggtgactacagccggccggccatggagatatcccccaatgtgtgccacagcagcatctactcacccaaggaggcagccccagaggagacacacagtgacatgcactacggtgtggccgagggccccaagcctgccgtcccctccgcccggaatgccccgtacttcccctgtgacaaggccagcaaggaggaagagaggccctcctcggaggatgagatcgccctgcatttcgagccccccagtgcacccctgaaccgcaagggtctggttagtccacagagcccccagaagtctgactgccagcccaactcgcccacggaatcctgcagcagcaagaatgcctgcatcctccagacctctgggtcacctccagctaagagccccaccgaccccaaagcctgcaactggaagaaatataagttcattgtgctgaacagcctcaaccagaatgccaaaccggaggggcccgagcaggccgagctgggccgcctttcccctcgagcctacactgccccgccggcctgccagccacccatggagcctgagagcctcgacctccagtccccaaccaagctcagcgccagtggggaggactccaccatcccacaggccagccggctcaataacatcgtcaacaggtccctgacaggctccccccgcagcagcagcgagagccactcaccgctctacttacacccccccaagtgcacatcctgcggctcgcagtccccacagcacgcggagatgtgcctccacaccgctgggcccacattccccgaggagatgggggagacccagtctgagtactcggattccagctgtgagaacggggccttcttttgcaatgagtgtgactgccgcttctctgaggaggcctcactcaagagacacacgctgcagacccacagtgacaaaccctacaagtgtgaccgctgccaggcctccttccgctacaagggcaacctcgccagccacaagaccgtccatacgggtgagaaaccctatcgctgtaatatctgtggagcccagttcaaccggccagccaacctgaaaactcatactcgaattcactctggagagaagccctacaaatgcgaaacctgtggtgcccgatttgtgcaagtggcccacctccgtgcccacgtgctcatccacactggagagaagccctatccctgtgaaatctgtggcacccgtttccggcaccttcagactctgaagagccacctgcgaatccacacaggagagaaaccttaccattgcgagaagtgcaacctgcatttccgtcacaaaagccagctgcgtcttcacttgcgccagaagcacggcgccatcaccaacaccaaggtacaataccgtgtgtccgccactgacctgcccccggagctccccaaagcctgctgaagcatggagtgttgatgctttccattcgagtcccttctcagaatctacccaaaggatactgtaacactttacaatgttcatcccatgatgtagtgcctctttcatccactagtgcaaatcatagcgggggtgggggtggggggcggggcgtggggactgggggccagagcagctccccgtcccccactgccataaaacattaagaaaataatattgcttcttctcctatgtgtaaggcaaaccatgtcagcaaaaagcaaaatcattttatatatcaaagtgggggagtatgcaaaagttctgacttgacttggtctgcaaaatgaggaatgtatatgtttggtggggacagatgtttcttttgtatgtaaatgtgcattcttttaaaagaagagacttccggtatgttatcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaacacaaaaagaacaaaaaaagctgccgaaggaaaatgtgtagttttgttctagttttcggtttgtatatacctgtacaacgtgtcctacggtgccttttttcatggaagttttcagtgatggacgagcgcgccatcccttctgaagtgtaggcagacacagggacttgaagttgtcgctaactaagctctctttgggaatgtttgtctcatcacattctgcgtcatgcttgtgttagaactactccggagacagggtttggctgtgtctaaactgcattaccgcgttgtaaaatatagctgtacaaatacaagaataaaatgttgaaaagtcaa

SEQ ID NO: 40 - protein, 706 aa, Canis lupus familiaris
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVPAIKPPREEFLNSRMLMPQDIMAYRGREVVENNLPLRNAPGCESRAFAPSLYSGLSTPPASYPVYGHLPVSSFLFSDEELRDARMPVANPFPKERALPCDSARPIPGDYSRPAMEISPNVCHSSIYSPKEAAPEETHSDMHYGVAEGPKPAVPSARNAPYFPCDKASKEEERPSSEDEIALHFEPPSAPLNRKGLVSPQSPQKSDCQPNSPTESCSSKNACILQTSGSPPAKSPTDPKACNWKKYKFIVLNSLNQNAKPEGPEQAELGRLSPRAYTAPPACQPPMEPESLDLQSPTKLSASGEDSTIPQASRLNNIVNRSLTGSPRSSSESHSPLYLHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 41 - DNA, 4437 bp, Canis lupus familiaris
  CDS (1245)..(3365)
tccaactcctttggaagacctgccttctcctcgaggtgcctaattgaaaatccagagctcctgaaaaggcagcggggagaaagtgtgtgggcggaaagacgacgtttaggtgtcgcttggtggttcctgcggctgggggcggggttggggtcgggccagtccaggtctgggcccttgcacttgtcaattctcttttgacagctccgttatcttggcagtttgtttctgtgttaggagtgttgtgtgcggcgtcggtggagtggctgaagctaggtaaaggagtttgtccaggactttgctggagactagcttttagactcgggcaaggcttatccagtggagtctcagtggccttcccagtaaatcagggcagctataaggatcccatacaataacggatgggaaagggctgagtggtctgtgagaaacaaggcagctgttaggtgcttccacacttgcagcatctagagggaggcatggcttcccacatctaccataacacacactcgctagctgtggggtttcctaagatagagctagctgaaggaggagtggacttaatagggatgtgggcctcggtgtatgtgcctttgcttttgaccaagccggacagacactgagaatgaaaatcgcccagccccagggcctggctgacaagtagacccctgggaatagggaatgttttgtttgtttcaatctgcaatatggagtgactcgttgccacttgccaaggtgaaatggcaaatctgggcttcctatggttccgaaagtctgtgactgggaattcgcaagcaagctggtggttgaagctggctaaaggacagctttaggtattccagaagtattcaggggtatctttcatgagggaagaggagacagtttataaatgaaactttcatgtgtcttcagcattctttctcaacagagataatcattgaactttggttaggacccatctggtgtgtctttctttgcccatcttgagttaggatgggagaggaggaagtaggttctttcagtctctttctgtcctctcccttccccccattcccttccctcatcctcactcactcacatgcacacactaaccttgaagccgatgggattgagtgactggcacttgggaccacagagaaatgtcagagtgtttggttacagactcaaggaaacctctcattttagagtgctcatttgattttaagcaaaattttggactgtgaatcaaggcattgggtgaagacaaaatggcctccccggctgacagctgtatccagttcacccgccatgccagtgacgtgcttctcaaccttaatcgcctccgcagccgtgacatcttgactgatgttgtcatcgtggtgagccgtgagcagttcagagcccataagacagtcctcatggcctgcagtggcctgttctacagcatcttcacagaccagttgaaatgtaaccttagtgtgatcaacctggatcctgagatcaaccctgaggggttctgcatcctcctggacttcatgtacacgtctcggctcaatctccgggagggcaacatcatggccgtgatggctacggcgatgtacctgcagatggagcatgtggtggacacctgccggaagtttatcaaggccagtgaagcagagatggttcctgccatcaagcctccccgtgaagagtttctgaatagccggatgctgatgccccaagacatcatggcctatcggggtcgtgaggtggtggagaataacctgccgctgaggaacgcccctgggtgtgagagcagagcctttgcccccagcctgtacagcggcctgtccaccccgccggcctcttatcccgtgtacggccacctcccagtcagcagcttcctcttctccgacgaggagctgcgggatgcccggatgcctgtggccaaccccttccctaaggagcgggccctcccctgcgatagtgccaggcccatccctggtgactacagccggccggccatggagatatcccccaatgtgtgccacagcagcatctactcacccaaggaggcagccccagaggagacacacagtgacatgcactacggtgtggccgagggccccaagcctgccgtcccctccgcccggaatgccccgtacttcccctgtgacaaggccagcaaggaggaagagaggccctcctcggaggatgagatcgccctgcatttcgagccccccagtgcacccctgaaccgcaagggtctggttagtccacagagcccccagaagtctgactgccagcccaactcgcccacggaatcctgcagcagcaagaatgcctgcatcctccagacctctgggtcacctccagctaagagccccaccgaccccaaagcctgcaactggaagaaatataagttcattgtgctgaacagcctcaaccagaatgccaaaccggaggggcccgagcaggccgagctgggccgcctttcccctcgagcctacactgccccgccggcctgccagccacccatggagcctgagagcctcgacctccagtccccaaccaagctcagcgccagtggggaggactccaccatcccacaggccagccggctcaataacatcgtcaacaggtccctgacaggctccccccgcagcagcagcgagagccactcaccgctctacttacacccccccaagtgcacatcctgcggctcgcagtccccacagcacgcggagatgtgcctccacaccgctgggcccacattccccgaggagatgggggagacccagtctgagtactcggattccagctgtgagaacggggccttcttttgcaatgagtgtgactgccgcttctctgaggaggcctcactcaagagacacacgctgcagacccacagtgacaaaccctacaagtgtgaccgctgccaggcctccttccgctacaagggcaacctcgccagccacaagaccgtccatacgggtgagaaaccctatcgctgtaatatctgtggagcccagttcaaccggccagccaacctgaaaactcatactcgaattcactctggagagaagccctacaaatgcgaaacctgtggtgcccgatttgtgcaagtggcccacctccgtgcccacgtgctcatccacactggagagaagccctatccctgtgaaatctgtggcacccgtttccggcaccttcagactctgaagagccacctgcgaatccacacaggagagaaaccttaccattgcgagaagtgcaacctgcatttccgtcacaaaagccagctgcgtcttcacttgcgccagaagcacggcgccatcaccaacaccaaggtacaataccgtgtgtccgccactgacctgcccccggagctccccaaagcctgctgaagcatggagtgttgatgctttccattcgagtcccttctcagaatctacccaaaggatactgtaacactttacaatgttcatcccatgatgtagtgcctctttcatccactagtgcaaatcatagcgggggtgggggtggggggcggggcgtggggactgggggccagagcagctccccgtcccccactgccataaaacattaagaaaataatattgcttcttctcctatgtgtaaggcaaaccatgtcagcaaaaagcaaaatcattttatatatcaaagtgggggagtatgcaaaagttctgacttgacttggtctgcaaaatgaggaatgtatatgtttggtggggacagatgtttcttttgtatgtaaatgtgcattcttttaaaagaagagacttccggtatgttatcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaacacaaaaagaacaaaaaaagctgccgaaggaaaatgtgtagttttgttctagttttcggtttgtatatacctgtacaacgtgtcctacggtgccttttttcatggaagttttcagtgatggacgagcgcgccatcccttctgaagtgtaggcagacacagggacttgaagttgtcgctaactaagctctctttgggaatgtttgtctcatcacattctgcgtcatgcttgtgttagaactactccggagacagggtttggctgtgtctaaactgcattaccgcgttgtaaaatatagctgtacaaatacaagaataaaatgttgaaaagtcaagtca

SEQ ID NO: 42 - protein, 706 aa, Canis lupus familiaris; identical to SEQ ID NO: 40

SEQ ID NO: 43 - DNA, 4731 bp, Canis lupus familiaris
  CDS (1539)..(3659)
gttctccagatctggagactgtgtctaaagtaggtcaatgggaaggagaggcggggctacacggggcttgtcggcttggagccttggtggagggctctccctagtgtttagccgcggtaagacatgagtaggtttgagctcccggaaccacgggagccctaatttccaataagtgcatgtacttaattttaacttcccttcctagatgctcaccccactccgcattaaatctcaaccttcgctttcacctttattacaccgggcgaagggatgagaaagtctcaaagtgcgactctctgaggccgccgaggcccagtcctcaccgaccggcccgacccgcctccgcggctgccgggatgcgccgcgcgctctgacgccccccgccggctcgaggactggactgcggcctccggcgctgcgtccttcccgcccctcgccccgggagattcctcccggagcccacggccggcgcctgcaaggagagggtgtccggggcttagagccccaaggcaggccccgagagagcgaggcatccttggagcgcgcccgcgcgctggggtcagcgccccggccggcccgcgggagcctaacggcgcctctacggttgcggggaaatcgggttccgaaatcccgaaacctggtcgggttcggcctcgcagctccttttctaaagacttgggggcggaaactgagcctagcagggctcccctacttgccagcgtaggcggaaggggctttcggtttggttttcctgcgcgtcggccgggcgcgcggacggagaccctcagcgcggggactcgctgctgcctgaccttgacgcccggcttcaccgccctcttaaagggggcggaggcaagcaaaaggcaaaaataaatacatgactcacgaggcgagcaaaggccagaattgggcaatttttgaagtcatgaaatgagcctcaggttggccccgaattcctgggttctagatgggctcggctgctaacttgcgcgagtttccccatttataagactgttgcggggggtggggggtggggggagggtcgggtgaatgcagagagctggacccgcgcgggcgagggatttaggggaaagtgcgcctccccgcccccccgtcccctcccctccccgggtgaatccccggcggccctcgcggcgcaggcggcgatcctggcggccgtcgggggccggcagcttcctggaaagttacttctcgttggagccggcgataggcagagagtgttctgtgaaatccgctgagcggagatcgactacgttccgggaatgagagggctgtgccattcccctcactagcccctgccttgacagcgtaacaggaaaaaaaaaaaaaaaaaaggcacacacaatgttagctaccgaagtgcacgaaacgttgtatttgaatgtcaccaaattaagggctgccacggtctctcctcggggcctccgcgggggctgcgcccgggggtgggcggtccctggcgggcagattttaagcaaaattttggactgtgaatcaaggcattgggtgaagacaaaatggcctccccggctgacagctgtatccagttcacccgccatgccagtgacgtgcttctcaaccttaatcgcctccgcagccgtgacatcttgactgatgttgtcatcgtggtgagccgtgagcagttcagagcccataagacagtcctcatggcctgcagtggcctgttctacagcatcttcacagaccagttgaaatgtaaccttagtgtgatcaacctggatcctgagatcaaccctgaggggttctgcatcctcctggacttcatgtacacgtctcggctcaatctccgggagggcaacatcatggccgtgatggctacggcgatgtacctgcagatggagcatgtggtggacacctgccggaagtttatcaaggccagtgaagcagagatggttcctgccatcaagcctccccgtgaagagtttctgaatagccggatgctgatgccccaagacatcatggcctatcggggtcgtgaggtggtggagaataacctgccgctgaggaacgcccctgggtgtgagagcagagcctttgcccccagcctgtacagcggcctgtccaccccgccggcctcttatcccgtgtacggccacctcccagtcagcagcttcctcttctccgacgaggagctgcgggatgcccggatgcctgtggccaaccccttccctaaggagcgggccctcccctgcgatagtgccaggcccatccctggtgactacagccggccggccatggagatatcccccaatgtgtgccacagcagcatctactcacccaaggaggcagccccagaggagacacacagtgacatgcactacggtgtggccgagggccccaagcctgccgtcccctccgcccggaatgccccgtacttcccctgtgacaaggccagcaaggaggaagagaggccctcctcggaggatgagatcgccctgcatttcgagccccccagtgcacccctgaaccgcaagggtctggttagtccacagagcccccagaagtctgactgccagcccaactcgcccacggaatcctgcagcagcaagaatgcctgcatcctccagacctctgggtcacctccagctaagagccccaccgaccccaaagcctgcaactggaagaaatataagttcattgtgctgaacagcctcaaccagaatgccaaaccggaggggcccgagcaggccgagctgggccgcctttcccctcgagcctacactgccccgccggcctgccagccacccatggagcctgagagcctcgacctccagtccccaaccaagctcagcgccagtggggaggactccaccatcccacaggccagccggctcaataacatcgtcaacaggtccctgacaggctccccccgcagcagcagcgagagccactcaccgctctacttacacccccccaagtgcacatcctgcggctcgcagtccccacagcacgcggagatgtgcctccacaccgctgggcccacattccccgaggagatgggggagacccagtctgagtactcggattccagctgtgagaacggggccttcttttgcaatgagtgtgactgccgcttctctgaggaggcctcactcaagagacacacgctgcagacccacagtgacaaaccctacaagtgtgaccgctgccaggcctccttccgctacaagggcaacctcgccagccacaagaccgtccatacgggtgagaaaccctatcgctgtaatatctgtggagcccagttcaaccggccagccaacctgaaaactcatactcgaattcactctggagagaagccctacaaatgcgaaacctgtggtgcccgatttgtgcaagtggcccacctccgtgcccacgtgctcatccacactggagagaagccctatccctgtgaaatctgtggcacccgtttccggcaccttcagactctgaagagccacctgcgaatccacacaggagagaaaccttaccattgcgagaagtgcaacctgcatttccgtcacaaaagccagctgcgtcttcacttgcgccagaagcacggcgccatcaccaacaccaaggtacaataccgtgtgtccgccactgacctgcccccggagctccccaaagcctgctgaagcatggagtgttgatgctttccattcgagtcccttctcagaatctacccaaaggatactgtaacactttacaatgttcatcccatgatgtagtgcctctttcatccactagtgcaaatcatagcgggggtgggggtggggggcggggcgtggggactgggggccagagcagctccccgtcccccactgccataaaacattaagaaaataatattgcttcttctcctatgtgtaaggcaaaccatgtcagcaaaaagcaaaatcattttatatatcaaagtgggggagtatgcaaaagttctgacttgacttggtctgcaaaatgaggaatgtatatgtttggtggggacagatgtttcttttgtatgtaaatgtgcattcttttaaaagaagagacttccggtatgttatcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaacacaaaaagaacaaaaaaagctgccgaaggaaaatgtgtagttttgttctagttttcggtttgtatatacctgtacaacgtgtcctacggtgccttttttcatggaagttttcagtgatggacgagcgcgccatcccttctgaagtgtaggcagacacagggacttgaagttgtcgctaactaagctctctttgggaatgtttgtctcatcacattctgcgtcatgcttgtgttagaactactccggagacagggtttggctgtgtctaaactgcattaccgcgttgtaaaatatagctgtacaaatacaagaataaaatgttgaaaagtcaagtca

SEQ ID NO: 44 - protein, 706 aa, Canis lupus familiaris; identical to SEQ ID NO: 40

SEQ ID NO: 45 - DNA, 3296 bp, Equus caballus
  CDS (114)..(2234)
tcttagaactggggttcttagaagtggtgatgcaagaagtttctaggaaaggccggacaccaggttttaagtgaaattttggactgtgaatcaaggcattgggtgaagacaaaatgacctcgccagctgacagctgtatccagttcacccgccatgccagtgacgttcttctcaatctcaatcgcctccggagccgtgacatcttgactgatgttgtcatagtggtgagccgtgagcagtttagagcccataagacagtcctcatggcctgcagtggcttgttctacagcatcttcacagaccagttgaaatgcaaccttagtgtaatcaatctggatccagagatcaaccccgaggggttctgcatcctcctggacttcatgtacacctctcggctcaacctgcgggagggcaacatcatggctgtgatggccacagccatgtacctgcagatggagcatgtcgtggacacctgccggaagtttatcaaggccagtgaagcagagatggttcctgccatcaaacctccccgtgaagagttcctgaacagccggatgctgatgccccaagacatcatggcctatcggggtcgtgaggtgatggagaacagcctgccgctgaggaatgcccccgggtgtgagagcagagcctttgcccccagcctgtacagtggcctgtccacaccgccagcttcctatcccgtgtacagccacctcccggtcagcagcttcctcttttccgatgaggagttgcgggatgcccggatgcctgtggccaatcctttccccaaggagcggacgctcccctgcgatagtgccaggccagtccctgttgagtacagtcggccggccatggagctgtcccacagtgtgtgccacagcaacatctactctcccaaggaggcagccccagaggaggcacggagtgacatgcactacagtgtggccgagggtcccaagcctgctgctccctcggcccggaatgccccatacttcccctgtgacaaggctggcaaggaggaagagagaccctcttcggaggatgagatcgctctgcatttcgagccccccagtgcccccctgaaccggaagggtctggttagtccacagagcccccagaagtccgactgccagcccaactcgcccacggagtcctgcagcagcaagaatgcctgcatcctccagacctctggctcccctccagccaagagccccactgaccccaaagcctgcaactggaagaaatacaagttcatcgtgctcaacagcctcaaccagaatgctaaaccagaggggcccgagcaggctgagctgggccgcctctcccctcgagcctacactgcacccccagcctgccagccacccatggagcccgagaaccttgacctccagtccccaactaagctcagtgccaatggggaggactccaccatcccgcaggccagccggctcaataacatcgtcaacaggtccttgacaggctccccccgcagcagcagcgagagccactcgccactctacctgcacccccccaagtgcacgtcctgcggctctcagtccccgcagcacgcggagatgtgcctccacaccgccggccccacgttccctgaggagatgggagagacccagtctgagtactcggattccagctgtgagaatggggccttcttctgcaatgagtgtgactgccgcttctctgaggaggcctccctcaagaggcacacgctgcagacccacagtgacaaaccctacaagtgtgaccggtgccaagcctccttccgctacaagggcaacctcgccagccacaagaccgtccacacgggtgagaaaccctatcgttgtaatatctgtggggcccagttcaaccggccagccaatctgaaaacccatactcgaattcactctggagagaagccctacaaatgcgaaacctgcggagccagatttgtacaggtggcccacctccgtgcccacgtgctcatccacactggcgagaagccctatccctgtgaaatctgtggcacccgtttccggcaccttcagactctgaagagccacctgcgaatccacacgggagagaaaccttaccattgcgagaagtgtaacctgcatttccgtcacaaaagccagctgcgtcttcacttgcgccagaagcacggtgccatcaccaacaccaaggtgcaataccgcgtgtctgccactgacctgcccccggaactccccaaagcctgctgaagcatggagtgttgatgctttccattcgagccccttctcagaatctacccaaaggatactgtaacactttaagatgttcatcccatgacgtagtgcctctttcatccactagtgcaaatcatagctgagggtgggggtggggggaggggcgtggggaccgggagccaaggcagctccccttcccccactgccgtaaaacattaagaaaataatattgcttcttctcctatgtgtacggcaaaccatgtcagcaaaaagcaaaatcattttcgataccgaagttggggagtacgcaaaagttctgacttgacttagtctgcaaaatgaggaatgtatatgttttgtgggaacagatgtttcttttgtatgtaaatgtgcattcttttaaaagaagagattaatggtatgttatgaaagagagggctttaatttttttaaccaaaggtgaaggaatatatggcagagttgtaaatatataaatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaagaacaaaaaaagctgcggaaggaaaaacgtgtagttttgttctagtttttggtttgtatatacctgtacaacgtgtcctacggtgccttttttcatggaagttttcaacgatggacgagcgcgccatccctttttgaagtgtaggcagacacagggacttgaaattgtcactaactaagctctctttgggaatgtttgtctcatcacattctgcgtcatgcttgtgttataactactccggagacagggtttggctgtgtctaaactgcattaccgcgttgtaaaatatagctgtacaaatacaagaataaaatgttgaaaagtcaa

SEQ ID NO: 46 - protein, 706 aa, Equus caballus
MTSPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVPAIKPPREEFLNSRMLMPQDIMAYRGREVMENSLPLRNAPGCESRAFAPSLYSGLSTPPASYPVYSHLPVSSFLFSDEELRDARMPVANPFPKERTLPCDSARPVPVEYSRPAMELSHSVCHSNIYSPKEAAPEEARSDMHYSVAEGPKPAAPSARNAPYFPCDKAGKEEERPSSEDEIALHFEPPSAPLNRKGLVSPQSPQKSDCQPNSPTESCSSKNACILQTSGSPPAKSPTDPKACNWKKYKFIVLNSLNQNAKPEGPEQAELGRLSPRAYTAPPACQPPMEPENLDLQSPTKLSANGEDSTIPQASRLNNIVNRSLTGSPRSSSESHSPLYLHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 47 - DNA, 5595 bp, Equus caballus
  CDS (2413)..(4533)
ctttccaaggacagttagtgccttccatcttcattaacgtgaataaagaccttggctgacttctgtccagatcggatttttaaaggcattgtttgcttggggagatcatgccgttcccctcccctgccagcctttttgcaaaggctgaacccagtccagccaggatggccgagatatctttgcttggggacgtggtttgctggcattgtcttccggccctttctggaaggctgtcgcgagccgggcgcatggggagcgtcccttctgcagctcctcttcagatcttgatgataaaacacatccctctattttattgcatttcctagaagcttgcaggcttgcaagaacgctgttggcaggaaacgtgacagaaatgaaagtccggacataatgtcccccaacacctcggtcactcaaagcgactgccgaggccaccgcgttatcaaattcgctttcatctactgtcgtctccccaccctcccgccccccagccaagagcgctaagagtgtttcccctctagaacaaaaacaactccgcgggttgaccctactctctgctgccggaccactgtgtctagacctgagcagctagttagctgagacgctgcggagaaagggagcgctccggcaggagccctgatgtgggtttcactgcgacagctccagccttattaaaattccttctccttgcccctaaacatgctttgcactttcagattctcctttggatttctcagcgagttattggagttattagattaccaataatccaaaagctggccaggagagcgaagagaggggaagggcgggaggcgttctccaaatctggagactgtgtctaaactaggtcaatgggaaggaggggcggggcgacaagggggttgtctgtttcaagcctaggtggagggctctctctagtgttaggcagcggtaagacatgatcaggtttgagctcccggaaccatgggactcctaatttccaataagagcatttacttaattttaacttcccttcctagattctcactccttcccatattaagtttcagcctctgctttcacatttatcctacgtggtaaagggatgggaaagcctcaaaggattttatgaggcggaagaggcccagtctttatggaccggccctgaccccgcctccgccactaataggatgcgcgactcagcgtgacgccacacgccagttttaggaccggactgcggcctgagacgctgcccgtttctcgccccttaacgcctattctttggcccccgaaagcgcctgtcgtacccggctactgagacccattaggagatggcgcccagggcttataattccaaggaaggccacgggaagacgaggcaaccttggagcgcgcccgtgcgcgcgctggggtcggcgcccgggcctctgccaaatcctaatcgtgtctctacggtttcggagaaatcagattctcaaatcccgaaacctggccaggttcggcctggcagctccttattctaaagtctttgggcggaaacccagccgagctgggttccccttcgtgccaacgtaggcggaaggggctttcggtttagttttcctctaacccggctgggacgcgctgggtggagaccccagccttagggactccgtattttcgaccttgacgcctcgcctaatcactcctttaaaaagaggggatgagggccaaacaaaaagagagaaaaaggaaaaaagacacggtatgcaccaggcaaacaaacgctggaattgggcaacttgaagtcatgaaataaacctcggattggccccgaaatcctgggttctaggccggctctgctactaatttgacttctcccatttataaaattattgtggggcaagggttggactaagtgaagtgtaagagtcccggacccggcgcagacgaggtttttaggggaaagtgtgccatattccccgcgagcctccccgggcggcccccccccttctcgggtgaatccccggaggcccgcgcggcgcaggcagcgatcccggcggccgtcggggccggcagcttcctggaaagttacttctcgttggagccggcgataggcaaagagtgttctgtgaaatccgctgagctgagattgactacgttccgggaatgagagggctgtgccgttcccctcactgccccccgccttgacggcgtaacaggaaaaagaaaggcacacacaatgttagctactgaggtgcacgaaaagttttacttgaatgtaaccaaattaagggctgccacggtcataccacggggcctctgccgcgcctgcggagccttcgaggcggatgggcagcggtgcccgcagagcgcccgggggtgggcggtctctggcagacaggttttaagtgaaattttggactgtgaatcaaggcattgggtgaagacaaaatgacctcgccagctgacagctgtatccagttcacccgccatgccagtgacgttcttctcaatctcaatcgcctccggagccgtgacatcttgactgatgttgtcatagtggtgagccgtgagcagtttagagcccataagacagtcctcatggcctgcagtggcttgttctacagcatcttcacagaccagttgaaatgcaaccttagtgtaatcaatctggatccagagatcaaccccgaggggttctgcatcctcctggacttcatgtacacctctcggctcaacctgcgggagggcaacatcatggctgtgatggccacagccatgtacctgcagatggagcatgtcgtggacacctgccggaagtttatcaaggccagtgaagcagagatggttcctgccatcaaacctccccgtgaagagttcctgaacagccggatgctgatgccccaagacatcatggcctatcggggtcgtgaggtgatggagaacagcctgccgctgaggaatgcccccgggtgtgagagcagagcctttgcccccagcctgtacagtggcctgtccacaccgccagcttcctatcccgtgtacagccacctcccggtcagcagcttcctcttttccgatgaggagttgcgggatgcccggatgcctgtggccaatcctttccccaaggagcggacgctcccctgcgatagtgccaggccagtccctgttgagtacagtcggccggccatggagctgtcccacagtgtgtgccacagcaacatctactctcccaaggaggcagccccagaggaggcacggagtgacatgcactacagtgtggccgagggtcccaagcctgctgctccctcggcccggaatgccccatacttcccctgtgacaaggctggcaaggaggaagagagaccctcttcggaggatgagatcgctctgcatttcgagccccccagtgcccccctgaaccggaagggtctggttagtccacagagcccccagaagtccgactgccagcccaactcgcccacggagtcctgcagcagcaagaatgcctgcatcctccagacctctggctcccctccagccaagagccccactgaccccaaagcctgcaactggaagaaatacaagttcatcgtgctcaacagcctcaaccagaatgctaaaccagaggggcccgagcaggctgagctgggccgcctctcccctcgagcctacactgcacccccagcctgccagccacccatggagcccgagaaccttgacctccagtccccaactaagctcagtgccaatggggaggactccaccatcccgcaggccagccggctcaataacatcgtcaacaggtccttgacaggctccccccgcagcagcagcgagagccactcgccactctacctgcacccccccaagtgcacgtcctgcggctctcagtccccgcagcacgcggagatgtgcctccacaccgccggccccacgttccctgaggagatgggagagacccagtctgagtactcggattccagctgtgagaatggggccttcttctgcaatgagtgtgactgccgcttctctgaggaggcctccctcaagaggcacacgctgcagacccacagtgacaaaccctacaagtgtgaccggtgccaagcctccttccgctacaagggcaacctcgccagccacaagaccgtccacacgggtgagaaaccctatcgttgtaatatctgtggggcccagttcaaccggccagccaatctgaaaacccatactcgaattcactctggagagaagccctacaaatgcgaaacctgcggagccagatttgtacaggtggcccacctccgtgcccacgtgctcatccacactggcgagaagccctatccctgtgaaatctgtggcacccgtttccggcaccttcagactctgaagagccacctgcgaatccacacgggagagaaaccttaccattgcgagaagtgtaacctgcatttccgtcacaaaagccagctgcgtcttcacttgcgccagaagcacggtgccatcaccaacaccaaggtgcaataccgcgtgtctgccactgacctgcccccggaactccccaaagcctgctgaagcatggagtgttgatgctttccattcgagccccttctcagaatctacccaaaggatactgtaacactttaagatgttcatcccatgacgtagtgcctctttcatccactagtgcaaatcatagctgagggtgggggtggggggaggggcgtggggaccgggagccaaggcagctccccttcccccactgccgtaaaacattaagaaaataatattgcttcttctcctatgtgtacggcaaaccatgtcagcaaaaagcaaaatcattttcgataccgaagttggggagtacgcaaaagttctgacttgacttagtctgcaaaatgaggaatgtatatgttttgtgggaacagatgtttcttttgtatgtaaatgtgcattcttttaaaagaagagattaatggtatgttatgaaagagagggctttaatttttttaaccaaaggtgaaggaatatatggcagagttgtaaatatataaatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaagaacaaaaaaagctgcggaaggaaaaacgtgtagttttgttctagtttttggtttgtatatacctgtacaacgtgtcctacggtgccttttttcatggaagttttcaacgatggacgagcgcgccatccctttttgaagtgtaggcagacacagggacttgaaattgtcactaactaagctctctttgggaatgtttgtctcatcacattctgcgtcatgcttgtgttataactactccggagacagggtttggctgtgtctaaactgcattaccgcgttgtaaaatatagctgtacaaatacaagaataaaatgttgaaaagtcaa

SEQ ID NO: 48 - protein, 706 aa, Equus caballus; identical to SEQ ID NO: 46

SEQ ID NO: 49 - DNA, 4704 bp, Equus caballus
  CDS (1522)..(3642)
tgtgatggggtgggcgaagctgcgggggcgtgctcccgggcgcacagggctcaggtttgtgcccgtgtgtgtgagcgagagaatggggctgcctagtgcccgccgattggaggagggagggaaagcatggggtcttcgtattggcttgttctcactcttaacctcgcctctcgctgttctgtgacctccacacttgtctctctccctctcgtttctgctatcttctcttctttctctttgcctttttttttttcttttgagggagaggtccctctttttccttttctaaatcctttaaaggatttgccttctcctcaaggtgcttaaatgaaaacacatacggaaagcaccaaaggagagaaagtgtgtagggtggagaagacaacgtttaactctcacttggtggttgctgcggatggggtggggttggggtcggggggtttgggatcgggggagtccgggtctgggcctttgagttgtcagtttctccttgacagctctgcttttttggttgtttttgtggaatgagtcttgtgtgtggcatgggtgggatgggtgaagctagtggacaggatttgtccagggttttgctggggattagttttgagatcctgggcaaggcttgtcggctggagcctcagtgtcctacccggtaaatcagggctgaggatcagatgcaataacggacgagaaagagctgagtggtctataaaaaacaacccaaaggcttccacacctgcagcacctagaaggaggctccattgctcacattcaccataacccacatactcactagttgtggggcctccgaagacagatctagcttaggaaggagtggacctagtaaggagaggggccttagtgtatgtgcatttgtttctggccaagccaggcagaatttagggtgataagtgcctaacccagggcctggctgacagtggacccaggggaattgttttgtttgtttgtttcattccgcatctggagtgagtcattgccacttgtcaaggtgaaatggcaaatctgagctccctgtggttgcacaagtctgtgactggaaatccacaagtgagcgggtggttgacgctggttaaagggcagccttaggtattccagaagtgtttagggatctcttctatgggggaagaggagaaagtttataaataaacccacgtgtgtcttcagcattcttttacaaaggagataatcatcgaacttcggttaggaccaattgagtgtatctctctgcccatcttgagttaggatggggagaggaggaaataggttcttttgtctttttctgtcctctcccttcccccatttcccccactcccccatccccactcacttacatgcacacactaaccttgaagcccatgagattgagtgacttgcacttgggaccacagagaaatgtcagagtgtttggttacagactcaaggaaacttctcattttagagtgctcatttggttttaagtgaaattttggactgtgaatcaaggcattgggtgaagacaaaatgacctcgccagctgacagctgtatccagttcacccgccatgccagtgacgttcttctcaatctcaatcgcctccggagccgtgacatcttgactgatgttgtcatagtggtgagccgtgagcagtttagagcccataagacagtcctcatggcctgcagtggcttgttctacagcatcttcacagaccagttgaaatgcaaccttagtgtaatcaatctggatccagagatcaaccccgaggggttctgcatcctcctggacttcatgtacacctctcggctcaacctgcgggagggcaacatcatggctgtgatggccacagccatgtacctgcagatggagcatgtcgtggacacctgccggaagtttatcaaggccagtgaagcagagatggttcctgccatcaaacctccccgtgaagagttcctgaacagccggatgctgatgccccaagacatcatggcctatcggggtcgtgaggtgatggagaacagcctgccgctgaggaatgcccccgggtgtgagagcagagcctttgcccccagcctgtacagtggcctgtccacaccgccagcttcctatcccgtgtacagccacctcccggtcagcagcttcctcttttccgatgaggagttgcgggatgcccggatgcctgtggccaatcctttccccaaggagcggacgctcccctgcgatagtgccaggccagtccctgttgagtacagtcggccggccatggagctgtcccacagtgtgtgccacagcaacatctactctcccaaggaggcagccccagaggaggcacggagtgacatgcactacagtgtggccgagggtcccaagcctgctgctccctcggcccggaatgccccatacttcccctgtgacaaggctggcaaggaggaagagagaccctcttcggaggatgagatcgctctgcatttcgagccccccagtgcccccctgaaccggaagggtctggttagtccacagagcccccagaagtccgactgccagcccaactcgcccacggagtcctgcagcagcaagaatgcctgcatcctccagacctctggctcccctccagccaagagccccactgaccccaaagcctgcaactggaagaaatacaagttcatcgtgctcaacagcctcaaccagaatgctaaaccagaggggcccgagcaggctgagctgggccgcctctcccctcgagcctacactgcacccccagcctgccagccacccatggagcccgagaaccttgacctccagtccccaactaagctcagtgccaatggggaggactccaccatcccgcaggccagccggctcaataacatcgtcaacaggtccttgacaggctccccccgcagcagcagcgagagccactcgccactctacctgcacccccccaagtgcacgtcctgcggctctcagtccccgcagcacgcggagatgtgcctccacaccgccggccccacgttccctgaggagatgggagagacccagtctgagtactcggattccagctgtgagaatggggccttcttctgcaatgagtgtgactgccgcttctctgaggaggcctccctcaagaggcacacgctgcagacccacagtgacaaaccctacaagtgtgaccggtgccaagcctccttccgctacaagggcaacctcgccagccacaagaccgtccacacgggtgagaaaccctatcgttgtaatatctgtggggcccagttcaaccggccagccaatctgaaaacccatactcgaattcactctggagagaagccctacaaatgcgaaacctgcggagccagatttgtacaggtggcccacctccgtgcccacgtgctcatccacactggcgagaagccctatccctgtgaaatctgtggcacccgtttccggcaccttcagactctgaagagccacctgcgaatccacacgggagagaaaccttaccattgcgagaagtgtaacctgcatttccgtcacaaaagccagctgcgtcttcacttgcgccagaagcacggtgccatcaccaacaccaaggtgcaataccgcgtgtctgccactgacctgcccccggaactccccaaagcctgctgaagcatggagtgttgatgctttccattcgagccccttctcagaatctacccaaaggatactgtaacactttaagatgttcatcccatgacgtagtgcctctttcatccactagtgcaaatcatagctgagggtgggggtggggggaggggcgtggggaccgggagccaaggcagctccccttcccccactgccgtaaaacattaagaaaataatattgcttcttctcctatgtgtacggcaaaccatgtcagcaaaaagcaaaatcattttcgataccgaagttggggagtacgcaaaagttctgacttgacttagtctgcaaaatgaggaatgtatatgttttgtgggaacagatgtttcttttgtatgtaaatgtgcattcttttaaaagaagagattaatggtatgttatgaaagagagggctttaatttttttaaccaaaggtgaaggaatatatggcagagttgtaaatatataaatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaagaacaaaaaaagctgcggaaggaaaaacgtgtagttttgttctagtttttggtttgtatatacctgtacaacgtgtcctacggtgccttttttcatggaagttttcaacgatggacgagcgcgccatccctttttgaagtgtaggcagacacagggacttgaaattgtcactaactaagctctctttgggaatgtttgtctcatcacattctgcgtcatgcttgtgttataactactccggagacagggtttggctgtgtctaaactgcattaccgcgttgtaaaatatagctgtacaaatacaagaataaaatgttgaaaagtcaa

SEQ ID NO: 50 - protein, 706 aa, Equus caballus; identical to SEQ ID NO: 46

SEQ ID NO: 51 - DNA, 6462 bp, Felis catus
  CDS (3265)..(5385)
ccccccgccccaaacagtgcgttgcactttcagattctcctttggatttctcagagagttattggtgttattagattaccaataatccaaaggccggccgggatagagaaaggtgggggtggggtggggatgtgaaaggcattctccgaatctggagcctgtgtctaaagtaggtcaatgggaaggagaggcggggctacatggatattgtcggtttctagccttgatggagggctctctctagtgtcaggcagcggtaaaacatgattaggttttagctcccggaaccacgggactcctaatttccaataagtgcatgtacttaattttaacttcccttcctagatactcaccccattccatattaaatttcaaccttcgctttcacctttattccaccgggcgaagggatgagaaagcctccaagtaagattttatgaggcggacgaggcccagtctttacctaccgcccggaccccgcctccgccgctgatgggatgcgcgacgcagtgagagaccacccgcgggttttaggagaggactatggcctcaggggctacgtctttcgtgcccctcgccccggaaaattactctcggagcccactactaggaccaattaggagagggcgcccaggggttataattccgaggaaggccatgagaacgctaggcaatccaggagctcgcccatgcgcgcgctggggtcagcgccccggtccctgcgcaatcctaaccgcgtctctacgtgtttcggagaaatcggattccgaaatcccgaaacctagccaggtttggcctggcagctcctattctaaagactttgggcggaaaccgagctgagcagggttcccctacttgccaacgtaggcggaaggggctttcggtttggttttgctccaggtcggctggtgcgcactggctggagaccctcagtcctagggactcccatctttctactttgacgcctggcctataaccagccccttaaggggagggggggggtggagcaagcaaaaagagagaaagggaaaaaaaaaagagagaaaaataaataaataaatgacgcaccaggcaaacaaacacgagaattaggcaattctaagtcctgaaatgagtttcggattggacccgaattcctgggttctggaccggctctgctactcacttgcgcgactttccccatgtataaaatttttgtgggggaagggttggaccgcgtgaactcagaatcctggatcgggcgccggcgagggatttaggggaaagtgtgcctattccccgcgagcctccctgggcggccccccctccccgggtgaatccccggcggccctcgcgccgcaggcagcgatcctggcggccgtcgggggccggcagcttcctggaaagttacttctcgttggaaacggcgataggcagagagtgttctgtgaaatccgctgagctgagatcgactatgttccgggaatgagagggctgtgccattcccctcactgcccactgccttgacggcgtaacaggaaaaaaaaaaaaaaaaaaaaaggcacacacaatgttagctaccgaagtgtacgaaacgttttatttgaatgtaaccaaattaaaggttgccacgatctcaccacggggcctccgacgcgcctgcgggggcttcgaggcagatgggccgcggcgcccgcagaacgcccgggggtgggcggtccctggcgggcaggtacggtaaggtaggggtgggcgcatctgcccgggcttgctgtggcgcgcagggctccggtttgtgcccgtgtgagcctgtgagaggaagcgcagtgcccgccgagcgggagagacagggaaagggtgaatggggggctttcgtgttggctcactctctctctcttaacctggccctcgttcttttctgccctcctctcttgtctctccgccttctccttcggctgccttctcttccctctctgccttttgtacagggagagggtccctcgtttttcttctccagctcctctgaaagatctgccttctcctcaaggtgccgaattgaaaatcccgagggaaaaggcagaggagagaaagtgtgtgggtggaaagacaatatttaggtctcacttcgtggttactgcggctggggcggggtaggggtggggggagcccacgtctgggcccttgcagttgtcagtttctctttgacagccctgttcttttggcggttgtttctgtgtaatgagtattgtgtgtggcgtccatgggattccggctgaagcttagtaagacagagtttgtccaggactttgctggagattagctttcagtcttgggcaaggcttatcccatgaagcgtcggtggcctccccagtaaatcagggctgttataaagatcacagacgatgatggatggggaaggcctgagtggtctgtaggaaacaaagcagctgctaggggtccttccacacttgcggcaaatagagggaggcatggcttcccacatccaccttaacacgcactcactagctgtgaggtcccctaagatagacccagctgaagaagaggtgggcttaataaggatgagcctcagtgtgtgtgcgtttgtttttgaccaagccaggcagaggtttaggatgaaaagtgcccagccccagggcctggctggcagacccacccccacccccaccccacccgcagggggcaggaggtgggaacgtgttgtttgtttgcttcgatctgcatatggagtgagtcattgccacttgtcaaggtgaaatggcagatctgggcttcctgtggttccaaaaatctgtgagtggaaatccacaagcgagctggtggttgaagctggctaaaggagagccttagatattccagaagtgttcagggatgttttgcaccgggggaagagaagacggtttgtaaatgaacctctcacgccgcgtctccagtgttcttttttcaacagagacaatcattgaactttggttaggacagttcagtgtatttctctttgcccgtcttgagttaggatggggagaggaggaaataggttctttcctctccttcttttcctctcccttccccactcccttcccttatcctcactcactcacatgcacacactaaccttgaagccgatgggattgagtgactggcacttgggaccacagagaaatgtcagagtgtttggttacagactcaaggaaacctctcattttagagtgctcatttgattttaagcaacattttggactgtgaatcaaggcattgggtgaagacaaaatggcctcgccggctgacagctgtatccagttcactcgccatgccagcgacgtgcttctcaaccttaaccgcctgcggagccgtgacatcttgaccgatgttgtcatcgtggtgagccgcgagcagttcagagcccataagacagtcctcatggcctgcagcggcctgttctatagcatcttcacagaccagttgaaatgtaacctgagcgtgatcaacctggatcctgagatcaaccccgaggggttctgcatcctcctggacttcatgtacacgtctcggctcaatctgcgggagggcaacatcatggccgtgatggctacggctatgtacctgcagatggagcacgttgtggacacttgccggaagtttatcaaggccagtgaagccgagatggttcctgccatcaagcctccccgtgacgagtttctgaatagccggatgctgatgccccaagacatcatggcctatcggggtcgtgaggtgatggagaataacctgccgctgaggaacgcccctgggtgtgagagcagggcgtttgcccccagcctgtacagcggcctgtccaccccgccagcctcttaccccgtgtacagccacctcccggtcagcagcttcctcttctccgatgaggagctgcgggatgcccggatgcccgtggccaaccccttccccaaggagcgggccctcccctgtgatagtgccaggcccgtacccggcgagtacagccggccggccatggagatgccccccagtgtgtgccacagcagcatctactcgcccaaggaggccgccccggaggaggcacgcagtgacatgcactacggcgtggccgagggccccaagccggccgccccctcggcccggaatgccccatacttcccctgtgacaaggccggcaaggaggaagagaggccctcctccgaggatgagatcgccctgcatttcgagccccccagtgcacccctgaaccggaagggtctggtgagtccgcagagcccgcagaagtctgactgccagcccaactcgcccacggagtcctgcagcagcaagaacgcctgcattctccagacctccggttcgccgccggccaagagccccaccgaccccaaagcctgcaactggaagaagtacaagttcattgtgctcaacagcctcaaccagaatgccaaaccagaggggcccgagcaggcggagctgggccgcctttcccctcgagcctacacggccccgccggcctgccagccgcccatggagcccgagagccttgacctccagtccccaaccaagcttagcgccagcggggaggactccaccatcccacaggccagccggctcaataacatcgtcaacaggtccctgaccggctccccccgcagcagcagcgagagccactcgcctctctacttgcacccccccaagtgcacatcctgcggctctcagtccccgcagcacgcggagatgtgcctccacaccgccggccccacattccccgaggagatgggagagacccagtctgagtactcggattccagctgtgagaacggggccttcttctgtaacgagtgtgactgccgcttctctgaggaggcctcgctcaagagacacacgctgcagacccacagcgacaaaccctacaagtgtgaccgctgccaggcctctttccgctacaagggcaacctcgccagccacaagactgtgcatacgggtgagaaaccctatcgctgtaacatctgtggagcccagttcaaccggccagccaacctgaaaacccatactcgaatccactctggagagaagccctacaaatgcgaaacctgtggagccagattcgtacaagtggcccacctccgtgcccacgtgctcatccacactggagagaagccctatccctgtgaaatctgtggcacccgtttccggcaccttcagactctgaagagccacttgcgaatccacacgggagagaaaccttaccattgcgagaagtgtaacctgcatttccgtcacaaaagccagctgcgtcttcacttgcgccagaagcacggcgccatcaccaacaccaaggtgcagtaccgtgtgtccgccactgacctgcccccggagctccccaaggcctgctgaagcatggagtgttgatgctttccattcgagtcccttctcagaaatctacccaaaggatactgtaacactttacgatgctcatcccatgacgtagtgcctctttcatccactagtgcaaatcatagctgggctggggtgggggggaggggcggggggaccgggagccaaggcagctccccttcccctactgccataaaacattaagaaaataatattgcttcttctcctatgtgtaaggcaaaccacgtcagcaaacggcaaaatcattttatatatcagagcggggggagtatgcaaaagttctgacttgacttggtctgcaaaatgaggaatgtatatgttttgtgggaacagctgtttcttttgtatgtaaatgtgcattcttttaaaagaagagacttcggtatgttatcaaagagagggctttaatttttttaaccaaaggtgaaggaatatatggcagagttgtaaatatataaatatatatatatataaaataaatatatataaacctaaaaaagatatattaaaaatataaaactgtgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaaaaaaccaacaaaaagaacaaaaaaagctaccgaaggaaaaatgtgtagttttgttctagttctcggtttgtatatacccgtacaacgtgtcctacggtgccttttttcatggaagttttcagtgatggacgagcacgccatcccttctgaggtgtaggcagacacagggacttgaagtcgtcgctaactaagctctctttgggaatgtttgtctcatcacattctgcgtcatgcttgtgttagaactactccggagacagggtttggctgtgtctaaactgcattaccgcgttgtaaaatatagctgtacaaatacaagaataaaacgttgaaaagtcaa

SEQ ID NO: 52 - protein, 706 aa, Felis catus
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVPAIKPPRDEFLNSRMLMPQDIMAYRGREVMENNLPLRNAPGCESRAFAPSLYSGLSTPPASYPVYSHLPVSSFLFSDEELRDARMPVANPFPKERALPCDSARPVPGEYSRPAMEMPPSVCHSSIYSPKEAAPEEARSDMHYGVAEGPKPAAPSARNAPYFPCDKAGKEEERPSSEDEIALHFEPPSAPLNRKGLVSPQSPQKSDCQPNSPTESCSSKNACILQTSGSPPAKSPTDPKACNWKKYKFIVLNSLNQNAKPEGPEQAELGRLSPRAYTAPPACQPPMEPESLDLQSPTKLSASGEDSTIPQASRLNNIVNRSLTGSPRSSSESHSPLYLHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 53 - DNA, 3336 bp, Felis catus
  CDS (139)..(2259)
attccgagaattgagctctgttgattcttagaactggggttcttagaagtggtgatgcaagaagtttctaggaaaggccggacaccagattttaagcaacattttggactgtgaatcaaggcattgggtgaagacaaaatggcctcgccggctgacagctgtatccagttcactcgccatgccagcgacgtgcttctcaaccttaaccgcctgcggagccgtgacatcttgaccgatgttgtcatcgtggtgagccgcgagcagttcagagcccataagacagtcctcatggcctgcagcggcctgttctatagcatcttcacagaccagttgaaatgtaacctgagcgtgatcaacctggatcctgagatcaaccccgaggggttctgcatcctcctggacttcatgtacacgtctcggctcaatctgcgggagggcaacatcatggccgtgatggctacggctatgtacctgcagatggagcacgttgtggacacttgccggaagtttatcaaggccagtgaagccgagatggttcctgccatcaagcctccccgtgacgagtttctgaatagccggatgctgatgccccaagacatcatggcctatcggggtcgtgaggtgatggagaataacctgccgctgaggaacgcccctgggtgtgagagcagggcgtttgcccccagcctgtacagcggcctgtccaccccgccagcctcttaccccgtgtacagccacctcccggtcagcagcttcctcttctccgatgaggagctgcgggatgcccggatgcccgtggccaaccccttccccaaggagcgggccctcccctgtgatagtgccaggcccgtacccggcgagtacagccggccggccatggagatgccccccagtgtgtgccacagcagcatctactcgcccaaggaggccgccccggaggaggcacgcagtgacatgcactacggcgtggccgagggccccaagccggccgccccctcggcccggaatgccccatacttcccctgtgacaaggccggcaaggaggaagagaggccctcctccgaggatgagatcgccctgcatttcgagccccccagtgcacccctgaaccggaagggtctggtgagtccgcagagcccgcagaagtctgactgccagcccaactcgcccacggagtcctgcagcagcaagaacgcctgcattctccagacctccggttcgccgccggccaagagccccaccgaccccaaagcctgcaactggaagaagtacaagttcattgtgctcaacagcctcaaccagaatgccaaaccagaggggcccgagcaggcggagctgggccgcctttcccctcgagcctacacggccccgccggcctgccagccgcccatggagcccgagagccttgacctccagtccccaaccaagcttagcgccagcggggaggactccaccatcccacaggccagccggctcaataacatcgtcaacaggtccctgaccggctccccccgcagcagcagcgagagccactcgcctctctacttgcacccccccaagtgcacatcctgcggctctcagtccccgcagcacgcggagatgtgcctccacaccgccggccccacattccccgaggagatgggagagacccagtctgagtactcggattccagctgtgagaacggggccttcttctgtaacgagtgtgactgccgcttctctgaggaggcctcgctcaagagacacacgctgcagacccacagcgacaaaccctacaagtgtgaccgctgccaggcctctttccgctacaagggcaacctcgccagccacaagactgtgcatacgggtgagaaaccctatcgctgtaacatctgtggagcccagttcaaccggccagccaacctgaaaacccatactcgaatccactctggagagaagccctacaaatgcgaaacctgtggagccagattcgtacaagtggcccacctccgtgcccacgtgctcatccacactggagagaagccctatccctgtgaaatctgtggcacccgtttccggcaccttcagactctgaagagccacttgcgaatccacacgggagagaaaccttaccattgcgagaagtgtaacctgcatttccgtcacaaaagccagctgcgtcttcacttgcgccagaagcacggcgccatcaccaacaccaaggtgcagtaccgtgtgtccgccactgacctgcccccggagctccccaaggcctgctgaagcatggagtgttgatgctttccattcgagtcccttctcagaaatctacccaaaggatactgtaacactttacgatgctcatcccatgacgtagtgcctctttcatccactagtgcaaatcatagctgggctggggtgggggggaggggcggggggaccgggagccaaggcagctccccttcccctactgccataaaacattaagaaaataatattgcttcttctcctatgtgtaaggcaaaccacgtcagcaaacggcaaaatcattttatatatcagagcggggggagtatgcaaaagttctgacttgacttggtctgcaaaatgaggaatgtatatgttttgtgggaacagctgtttcttttgtatgtaaatgtgcattcttttaaaagaagagacttcggtatgttatcaaagagagggctttaatttttttaaccaaaggtgaaggaatatatggcagagttgtaaatatataaatatatatatatataaaataaatatatataaacctaaaaaagatatattaaaaatataaaactgtgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaaaaaaccaacaaaaagaacaaaaaaagctaccgaaggaaaaatgtgtagttttgttctagttctcggtttgtatatacccgtacaacgtgtcctacggtgccttttttcatggaagttttcagtgatggacgagcacgccatcccttctgaggtgtaggcagacacagggacttgaagtcgtcgctaactaagctctctttgggaatgtttgtctcatcacattctgcgtcatgcttgtgttagaactactccggagacagggtttggctgtgtctaaactgcattaccgcgttgtaaaatatagctgtacaaatacaagaataaaacgttgaaaagtcaa

SEQ ID NO: 54 - protein, 706 aa, Felis catus; identical to SEQ ID NO: 52

SEQ ID NO: 55 - DNA, 4959 bp, Felis catus
  CDS (1762)..(3882)
ccccccgccccaaacagtgcgttgcactttcagattctcctttggatttctcagagagttattggtgttattagattaccaataatccaaaggccggccgggatagagaaaggtgggggtggggtggggatgtgaaaggcattctccgaatctggagcctgtgtctaaagtaggtcaatgggaaggagaggcggggctacatggatattgtcggtttctagccttgatggagggctctctctagtgtcaggcagcggtaaaacatgattaggttttagctcccggaaccacgggactcctaatttccaataagtgcatgtacttaattttaacttcccttcctagatactcaccccattccatattaaatttcaaccttcgctttcacctttattccaccgggcgaagggatgagaaagcctccaagtaagattttatgaggcggacgaggcccagtctttacctaccgcccggaccccgcctccgccgctgatgggatgcgcgacgcagtgagagaccacccgcgggttttaggagaggactatggcctcaggggctacgtctttcgtgcccctcgccccggaaaattactctcggagcccactactaggaccaattaggagagggcgcccaggggttataattccgaggaaggccatgagaacgctaggcaatccaggagctcgcccatgcgcgcgctggggtcagcgccccggtccctgcgcaatcctaaccgcgtctctacgtgtttcggagaaatcggattccgaaatcccgaaacctagccaggtttggcctggcagctcctattctaaagactttgggcggaaaccgagctgagcagggttcccctacttgccaacgtaggcggaaggggctttcggtttggttttgctccaggtcggctggtgcgcactggctggagaccctcagtcctagggactcccatctttctactttgacgcctggcctataaccagccccttaaggggagggggggggtggagcaagcaaaaagagagaaagggaaaaaaaaaagagagaaaaataaataaataaatgacgcaccaggcaaacaaacacgagaattaggcaattctaagtcctgaaatgagtttcggattggacccgaattcctgggttctggaccggctctgctactcacttgcgcgactttccccatgtataaaatttttgtgggggaagggttggaccgcgtgaactcagaatcctggatcgggcgccggcgagggatttaggggaaagtgtgcctattccccgcgagcctccctgggcggccccccctccccgggtgaatccccggcggccctcgcgccgcaggcagcgatcctggcggccgtcgggggccggcagcttcctggaaagttacttctcgttggaaacggcgataggcagagagtgttctgtgaaatccgctgagctgagatcgactatgttccgggaatgagagggctgtgccattcccctcactgcccactgccttgacggcgtaacaggaaaaaaaaaaaaaaaaaaaaaggcacacacaatgttagctaccgaagtgtacgaaacgttttatttgaatgtaaccaaattaaaggttgccacgatctcaccacggggcctccgacgcgcctgcgggggcttcgaggcagatgggccgcggcgcccgcagaacgcccgggggtgggcggtccctggcgggcagattttaagcaacattttggactgtgaatcaaggcattgggtgaagacaaaatggcctcgccggctgacagctgtatccagttcactcgccatgccagcgacgtgcttctcaaccttaaccgcctgcggagccgtgacatcttgaccgatgttgtcatcgtggtgagccgcgagcagttcagagcccataagacagtcctcatggcctgcagcggcctgttctatagcatcttcacagaccagttgaaatgtaacctgagcgtgatcaacctggatcctgagatcaaccccgaggggttctgcatcctcctggacttcatgtacacgtctcggctcaatctgcgggagggcaacatcatggccgtgatggctacggctatgtacctgcagatggagcacgttgtggacacttgccggaagtttatcaaggccagtgaagccgagatggttcctgccatcaagcctccccgtgacgagtttctgaatagccggatgctgatgccccaagacatcatggcctatcggggtcgtgaggtgatggagaataacctgccgctgaggaacgcccctgggtgtgagagcagggcgtttgcccccagcctgtacagcggcctgtccaccccgccagcctcttaccccgtgtacagccacctcccggtcagcagcttcctcttctccgatgaggagctgcgggatgcccggatgcccgtggccaaccccttccccaaggagcgggccctcccctgtgatagtgccaggcccgtacccggcgagtacagccggccggccatggagatgccccccagtgtgtgccacagcagcatctactcgcccaaggaggccgccccggaggaggcacgcagtgacatgcactacggcgtggccgagggccccaagccggccgccccctcggcccggaatgccccatacttcccctgtgacaaggccggcaaggaggaagagaggccctcctccgaggatgagatcgccctgcatttcgagccccccagtgcacccctgaaccggaagggtctggtgagtccgcagagcccgcagaagtctgactgccagcccaactcgcccacggagtcctgcagcagcaagaacgcctgcattctccagacctccggttcgccgccggccaagagccccaccgaccccaaagcctgcaactggaagaagtacaagttcattgtgctcaacagcctcaaccagaatgccaaaccagaggggcccgagcaggcggagctgggccgcctttcccctcgagcctacacggccccgccggcctgccagccgcccatggagcccgagagccttgacctccagtccccaaccaagcttagcgccagcggggaggactccaccatcccacaggccagccggctcaataacatcgtcaacaggtccctgaccggctccccccgcagcagcagcgagagccactcgcctctctacttgcacccccccaagtgcacatcctgcggctctcagtccccgcagcacgcggagatgtgcctccacaccgccggccccacattccccgaggagatgggagagacccagtctgagtactcggattccagctgtgagaacggggccttcttctgtaacgagtgtgactgccgcttctctgaggaggcctcgctcaagagacacacgctgcagacccacagcgacaaaccctacaagtgtgaccgctgccaggcctctttccgctacaagggcaacctcgccagccacaagactgtgcatacgggtgagaaaccctatcgctgtaacatctgtggagcccagttcaaccggccagccaacctgaaaacccatactcgaatccactctggagagaagccctacaaatgcgaaacctgtggagccagattcgtacaagtggcccacctccgtgcccacgtgctcatccacactggagagaagccctatccctgtgaaatctgtggcacccgtttccggcaccttcagactctgaagagccacttgcgaatccacacgggagagaaaccttaccattgcgagaagtgtaacctgcatttccgtcacaaaagccagctgcgtcttcacttgcgccagaagcacggcgccatcaccaacaccaaggtgcagtaccgtgtgtccgccactgacctgcccccggagctccccaaggcctgctgaagcatggagtgttgatgctttccattcgagtcccttctcagaaatctacccaaaggatactgtaacactttacgatgctcatcccatgacgtagtgcctctttcatccactagtgcaaatcatagctgggctggggtgggggggaggggcggggggaccgggagccaaggcagctccccttcccctactgccataaaacattaagaaaataatattgcttcttctcctatgtgtaaggcaaaccacgtcagcaaacggcaaaatcattttatatatcagagcggggggagtatgcaaaagttctgacttgacttggtctgcaaaatgaggaatgtatatgttttgtgggaacagctgtttcttttgtatgtaaatgtgcattcttttaaaagaagagacttcggtatgttatcaaagagagggctttaatttttttaaccaaaggtgaaggaatatatggcagagttgtaaatatataaatatatatatatataaaataaatatatataaacctaaaaaagatatattaaaaatataaaactgtgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaaaaaaaaccaacaaaaagaacaaaaaaagctaccgaaggaaaaatgtgtagttttgttctagttctcggtttgtatatacccgtacaacgtgtcctacggtgccttttttcatggaagttttcagtgatggacgagcacgccatcccttctgaggtgtaggcagacacagggacttgaagtcgtcgctaactaagctctctttgggaatgtttgtctcatcacattctgcgtcatgcttgtgttagaactactccggagacagggtttggctgtgtctaaactgcattaccgcgttgtaaaatatagctgtacaaatacaagaataaaacgttgaaaagtcaa

SEQ ID NO: 56 - protein, 706 aa, Felis catus; identical to SEQ ID NO: 52

SEQ ID NO: 57 - DNA, 3279 bp, Bos taurus
  CDS (85)..(2205)
ctcaaggaaacctctcattttagagtgctcatttggttttaagcaaaattttggactgtgaatcaaggcactgggtgaagaaaaatggcctcgccggctgacagctgtatccagttcacccgccatgccagtgacgttcttctcaaccttaatcgactccggagccgtgacatcttgactgatgttgtcatagtggtgagccgggagcagtttagagcccataagacagtcctcatggcctgcagtggcctgttctacagcatcttcacagaccagttgaaatgcaacctcagtgtgatcaatctggatcctgagatcaacccggaggggttctgcatcctcctggacttcatgtacacatctcggctcaatctgcgggagggcaacatcatggccgtgatggccacagctatgtaccttcagatggagcatgttgtggacacttgccggaagttcatcaaggccagtgaagcagagatggttcctgccatcaagcctccccgtgaagacttcctcaacagccgcatgctgatgccccaggacatcatggcctatcggggccgggaggtggtggagaacagcctgccactgaggaacgcccccggatgtgagagcagagcttttgcccccagcttgtacaatggcctgtccacaccgccagcctcataccctgtgtacggccaccttccggtcagcagcttccttttctctgatgaggagctccgggatgcccggatgcctatagccaaccccttccccaaggatcgggccctcccctgcgacagtgccaggccagtgcccagtgagtacagtcggccggccatggagatctcccccagcgtgtgccacagcaccatctactcgcccaaggaggcggctcctgaggaggcgcggagtgacatgcactacagtgtggccgagggccccaagcctgctgcgccctcagcccggagcgccccatacttcccctgtgataaggccggcaaggaggaagagcggccctcctcggaagatgagattgccctgcatttcgagccccccaatgcacccctgaacaggaagggtctggttagcccacaaagtccccagaagtctgactgccagcccaactcccctacggagtcctgtagcagcaagaacgcctgcatcctccagacctctgggtccccgccggccaagagccccactgaccccaaagcctgcaactggaagaagtacaagttcatcgtgctcaacagtctcaaccagaacgccaaaccggaggggcctgagcaggcagagctgggccgcctttccccccgagcctatgctgccccgccagcctgccagccacccatggagcctgatagccttgacctccagtccccaactaagctcagcaccagtgcggaggactccaccatcccacaggccagtcggctcaacaacattgtcaacaggtccctgactggctcccccagaagcagcagcgagagccactcgccgctctacctgcacccccccaagtgcacatcctgcggctcgcagtccccgcagcacgcagagatgtgcctgcatgctgctggccccacgttccccgaggagctgggagagacccagtctgagtactcagattccagctgcgagaatggggccttcttctgcaatgagtgtgactgccgcttttctgaggaggcttccctcaagaggcacacgctgcagacccacagtgacaaaccctacaagtgtgaccgctgccaggcctccttccgctacaagggcaacctcgccagccacaagaccgtccacacgggtgagaaaccctatcgttgtaacatttgcggggcccagttcaaccgaccggccaacctgaaaacccacacccgaattcactctggagagaagccctacaaatgcgaaacgtgcggagccagatttgtccaggtggcccacctccgtgcccatgtgctcatccacactggcgagaagccctatccctgtgaaatctgtggcacccgattccggcaccttcagactctgaagagccacctgcgaatccacacaggagagaaaccttaccattgtgagaagtgtaacctgcatttccgtcacaaaagtcagctccgtcttcacttgcgccagaagcacggcgccatcaccaacaccaaggtgcaatatcgcgtgtccgccactgacctgcccccggagctccccaaagcctgctgaagcatggagtgttgatgctttccattcgagccccttttcggaatctacccaaaggatactgtaacactttacaatgttcatcccatgatgtagtgcctctttcatccactagcgcaaatcctagctggcgggggcggggtggggggaggggcgggggacggggcgccagggcagctccccttcccccactgccgtaaaactttaagaaaataatattgcttcttctcctatgtgtacggcgaaccatgtcagcaaaaagcaaaatcattttatatatcaaagcgggggaagtacgcaaaagttctgacttgacttagtctgcaaaatgaggaatgtatatgttttgtgggatcagatgtttcttttgtatgtaaatgtgcattcttttaaaagaagagacttcggtatgttatcaaagagagggctttaatttttttaaccaaaggtgaaggaatatatggcagagttgtaaatatataaatatatatatataaaataaatatatataaacctaaaaaagatatattaaaaatataaaactgcgttaaaggctcgattttgtatctgcaggcagacacggatctgagaatctttattgagaaagagcacttaagagactattttaagtattgcatctgtataagtaagaaaatattttgtctaaaatgcctcagtgtatttgtatttttttgcaagtgaaggtttacaatttacaaagtgtgtattaaaacaaacaaacaaaaagaacaaaaaaagctgcggaaggagaaaacgtgtagttttgttctagttttcggtttgtatatacccgtacaacgtgtcctacggtgccttttttcatggaagttttcaacaggggacgactgcgccatcccttttggacgtgtaggcagacacagggacttggagttgtcactaactaagctctctttgggaatgtttgtctcatcacattctgcgtcatgcttgtgttataactactccggagacagggtttggctgtgtctaaactgcattaccgcgttgtaaaatatagctgtacaaatacaagaataaaatgaaaagtcaaatcgg

SEQ ID NO: 58 - protein, 706 aa, Bos taurus
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVPAIKPPREDFLNSRMLMPQDIMAYRGREVVENSLPLRNAPGCESRAFAPSLYNGLSTPPASYPVYGHLPVSSFLFSDEELRDARMPIANPFPKDRALPCDSARPVPSEYSRPAMEISPSVCHSTIYSPKEAAPEEARSDMHYSVAEGPKPAAPSARSAPYFPCDKAGKEEERPSSEDEIALHFEPPNAPLNRKGLVSPQSPQKSDCQPNSPTESCSSKNACILQTSGSPPAKSPTDPKACNWKKYKFIVLNSLNQNAKPEGPEQAELGRLSPRAYAAPPACQPPMEPDSLDLQSPTKLSTSAEDSTIPQASRLNNIVNRSLTGSPRSSSESHSPLYLHPPKCTSCGSQSPQHAEMCLHAAGPTFPEELGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 59 - DNA, 3340 bp, Bos taurus
  CDS (135)..(2255)
ccgagaattgagctctgttgattcttagaactggggttcttagaagtggtgatgcaagaagtttctaggaaaggccggacaccaggttttaagcaaaattttggactgtgaatcaaggcactgggtgaagaaaaatggcctcgccggctgacagctgtatccagttcacccgccatgccagtgacgttcttctcaaccttaatcgactccggagccgtgacatcttgactgatgttgtcatagtggtgagccgggagcagtttagagcccataagacagtcctcatggcctgcagtggcctgttctacagcatcttcacagaccagttgaaatgcaacctcagtgtgatcaatctggatcctgagatcaacccggaggggttctgcatcctcctggacttcatgtacacatctcggctcaatctgcgggagggcaacatcatggccgtgatggccacagctatgtaccttcagatggagcatgttgtggacacttgccggaagttcatcaaggccagtgaagcagagatggttcctgccatcaagcctccccgtgaagacttcctcaacagccgcatgctgatgccccaggacatcatggcctatcggggccgggaggtggtggagaacagcctgccactgaggaacgcccccggatgtgagagcagagcttttgcccccagcttgtacaatggcctgtccacaccgccagcctcataccctgtgtacggccaccttccggtcagcagcttccttttctctgatgaggagctccgggatgcccggatgcctatagccaaccccttccccaaggatcgggccctcccctgcgacagtgccaggccagtgcccagtgagtacagtcggccggccatggagatctcccccagcgtgtgccacagcaccatctactcgcccaaggaggcggctcctgaggaggcgcggagtgacatgcactacagtgtggccgagggccccaagcctgctgcgccctcagcccggagcgccccatacttcccctgtgataaggccggcaaggaggaagagcggccctcctcggaagatgagattgccctgcatttcgagccccccaatgcacccctgaacaggaagggtctggttagcccacaaagtccccagaagtctgactgccagcccaactcccctacggagtcctgtagcagcaagaacgcctgcatcctccagacctctgggtccccgccggccaagagccccactgaccccaaagcctgcaactggaagaagtacaagttcatcgtgctcaacagtctcaaccagaacgccaaaccggaggggcctgagcaggcagagctgggccgcctttccccccgagcctatgctgccccgccagcctgccagccacccatggagcctgatagccttgacctccagtccccaactaagctcagcaccagtgcggaggactccaccatcccacaggccagtcggctcaacaacattgtcaacaggtccctgactggctcccccagaagcagcagcgagagccactcgccgctctacctgcacccccccaagtgcacatcctgcggctcgcagtccccgcagcacgcagagatgtgcctgcatgctgctggccccacgttccccgaggagctgggagagacccagtctgagtactcagattccagctgcgagaatggggccttcttctgcaatgagtgtgactgccgcttttctgaggaggcttccctcaagaggcacacgctgcagacccacagtgacaaaccctacaagtgtgaccgctgccaggcctccttccgctacaagggcaacctcgccagccacaagaccgtccacacgggtgagaaaccctatcgttgtaacatttgcggggcccagttcaaccgaccggccaacctgaaaacccacacccgaattcactctggagagaagccctacaaatgcgaaacgtgcggagccagatttgtccaggtggcccacctccgtgcccatgtgctcatccacactggcgagaagccctatccctgtgaaatctgtggcacccgattccggcaccttcagactctgaagagccacctgcgaatccacacaggagagaaaccttaccattgtgagaagtgtaacctgcatttccgtcacaaaagtcagctccgtcttcacttgcgccagaagcacggcgccatcaccaacaccaaggtgcaatatcgcgtgtccgccactgacctgcccccggagctccccaaagcctgctgaagcatggagtgttgatgctttccattcgagccccttttcggaatctacccaaaggatactgtaacactttacaatgttcatcccatgatgtagtgcctctttcatccactagcgcaaatcctagctggcgggggcggggtggggggaggggcgggggacggggcgccagggcagctccccttcccccactgccgtaaaactttaagaaaataatattgcttcttctcctatgtgtacggcgaaccatgtcagcaaaaagcaaaatcattttatatatcaaagcgggggaagtacgcaaaagttctgacttgacttagtctgcaaaatgaggaatgtatatgttttgtgggatcagatgtttcttttgtatgtaaatgtgcattcttttaaaagaagagacttcggtatgttatcaaagagagggctttaatttttttaaccaaaggtgaaggaatatatggcagagttgtaaatatataaatatatatatataaaataaatatatataaacctaaaaaagatatattaaaaatataaaactgcgttaaaggctcgattttgtatctgcaggcagacacggatctgagaatctttattgagaaagagcacttaagagactattttaagtattgcatctgtataagtaagaaaatattttgtctaaaatgcctcagtgtatttgtatttttttgcaagtgaaggtttacaatttacaaagtgtgtattaaaacaaacaaacaaaaagaacaaaaaaagctgcggaaggagaaaacgtgtagttttgttctagttttcggtttgtatatacccgtacaacgtgtcctacggtgccttttttcatggaagttttcaacaggggacgactgcgccatcccttttggacgtgtaggcagacacagggacttggagttgtcactaactaagctctctttgggaatgtttgtctcatcacattctgcgtcatgcttgtgttataactactccggagacagggtttggctgtgtctaaactgcattaccgcgttgtaaaatatagctgtacaaatacaagaataaaatgaaaagtcaaatcggtttgttctgga

SEQ ID NO: 60 - protein, 706 aa, Bos taurus; identical to SEQ ID NO: 58

SEQ ID NO: 61 - DNA, 3389 bp, Rattus norvegicus
  CDS (192)..(2315)
gctgccacggagtcctcccctgctgtggagcaatggtaaagcccgcagctcaaattccgagaattgagctctgttgattcttagaactggggttcttagaagtggtgatgcaagaagtttctaggaaaggccggacaccagttttaaagcaaaattttggactgtgaagcaaggcattgggcaaacacaacatggcctcaccggctgacagctgtatccagttcacccgccatgctagtgatgttcttctcaaccttaaccgcctccgaagtcgggacatcttgaccgacgttgtcatcgtggtgagccgtgagcagtttagagcccataagacagtgctcatggcctgcagtggcctgttctacagcatcttcactgaccagttgaaatgcaaccttagtgtaatcaatctggatcctgagatcagccctgaggggttttgcatcctcttggacttcatgtacacatctaggctcaacctgagggaaggcaacatcatggccgtgatggccacagccatgtacctgcagatggagcatgttgtcgacacatgccggaagttcatcaaggccagtgaagcagaaatggcccctgcacttaagcctccccgtgaagagttcctgaacagccggatgctgatgccccatgacgtcatggcctatcgaggtcgtgaggttgtggagaacaatatgccactaagaaatactcccgggtgtgagagtagagcttttgcccctcccctgtacagtggcctgtcgacaccaccagcctcttatccgatgtatagccatctcccgctcagcagtttcctcttctccgacgaggaactacgagatgccccccgaatgcctgtggctaacccttttcccaaggagcgcgccctcccctgtgacagtgccaggccagtccctaatgagtatagcaggccaaccatggaggtgtcccccagcttgtgccacagcaatatctactcgcccaaggaggcagtcccagaggaggctcggagtgacatacactacagtgtgactgagggccccaagcctgctgccccttctgctcggcatgcctcgtacttcccctgtgacaaagccagcaaagaagaagagagaccctcttcagaggacgagatcgccctgcatttcgagccccccaatgcacccttgaaccggaagggtctggttagtccccagagtccgcagaaatccgactgccagcccaactcacccacagagtcctccagcagcaagaacgcctgcatccttcaggcctctggctctcctccagccaagagccccactgatccgaaagcctgcaactggaagaagtataagttcatcgttctcaacagcctcaatcagaatgccaagccagagggctctgagcaggcagagctgggccgcctctccccacgagcctaccctgcaccgccggcctgccagccgcctatggagcctgcgaaccttgatctccagtctccaaccaagctcagtgccagtggggaggactctaccatcccccaagccagccggctcaataacatcgttaacaggtccctggcaggctccccccgaagcagcagcgagagccactcgccactctacatgcaccccccgaagtgcacatcctgcggctctcagtccccacagcatacagagatgtgtctccatactgccgggcccacattcccggaggagatgggagagacccagtcagagtattcggattctagctgtgagaatggggccttcttctgcaatgaatgtgactgccgtttttctgaggaggcctcactcaagaggcacacgctgcagacgcacagtgacaaaccatacaaatgtgaccgctgccaggcctccttccgctacaaaggcaacctcgccagccacaagacggtccacacaggtgaaaaaccctaccgctgtaacatttgtggagcgcagttcaatcggccagccaacctgaagacccacactcgaattcactctggagaaaagccctacaaatgtgaaacctgtggggccagatttgtgcaggtggctcacctccgtgcccacgtgctcatccacactggagagaagccgtacccctgtgaaatctgtggtacccgcttcaggcaccttcagactctaaagagccatctgcgcatccacacaggagagaaaccgtaccattgtgagaagtgtaacctgcactttcgtcacaaaagccaactgcgacttcatttgcgtcagaaacatggcgccatcaccaacaccaaggtgcaataccgtgtgtcggccgctgatttgcctccggagctccccaaagcctgctgaagcatggagtgttgactctttttctctccagccccttctcagaatctacccaaaggatgctgtaacactttacaaaggtcatcccatgacgtagtgcctctctcatccactagagcaaatcatagttggggtgggggtgggggtgggggtggggtttgcgggaccgggagccaaggcagctctccttcccacactgccataaaacattaagaaaatactatcgcttcttctcctatgtgtaaggcaaaccacgtcagcaaaaatgcaaaatcattttcaatatcaaaataggggagaacgcagaagttctgacttgacaggttgcaacatgaggaatgtaaatgttctgtggggacagagatctcttttgtatgtaaatgtgcattgttttaaaagacaagacttcagtatgttgtcaaagagagggctttaattttttaaccaaaggtgaaggaatatatggcagagttgtaaatatataaatatatatatatataatataaatatataaacctaaaaagatatattgaaaatataaaactgtgttaaaggctcgattttgtatctgcaggcagacacggatctgagaatctttattgagaaagagcacttaagagactattttaagtattatgtctgtataagtaagaaaatattttgtctaaaatgcctccgtgtatttgtatttttttgcaagtgaaggtttacaatttacaaagtgtgtattaaaaacaaaaaagaacaaaaaaaagctgcagaaggagaaatgtatacttttgttctggttttcactttgtacatacctgtaaacgtgtcctcacggtgcctttttacacggaagttttcaatgatggacgggtgtgggccatccctttttgaagtgtaggcagacacagggacttgaagttgtcactaactaaactctctttgggaatgtttgactcctcccacattctgcgtcatgcttgttataattactccggagacagggtttggctgtgtctaaactgcattagtgcgttgtaaaatatagctgtatctgtataaaatataagaataaaacatggaaaagtc

SEQ ID NO: 62 - protein, 707 aa, Rattus norvegicus
MASPADSCIQFTRHASDVLLNLNRLRSRDILTDVVIVVSREQFRAHKTVLMACSGLFYSIFTDQLKCNLSVINLDPEISPEGFCILLDFMYTSRLNLREGNIMAVMATAMYLQMEHVVDTCRKFIKASEAEMAPALKPPREEFLNSRMLMPHDVMAYRGREVVENNMPLRNTPGCESRAFAPPLYSGLSTPPASYPMYSHLPLSSFLFSDEELRDAPRMPVANPFPKERALPCDSARPVPNEYSRPTMEVSPSLCHSNIYSPKEAVPEEARSDIHYSVTEGPKPAAPSARHASYFPCDKASKEEERPSSEDEIALHFEPPNAPLNRKGLVSPQSPQKSDCQPNSPTESSSSKNACILQASGSPPAKSPTDPKACNWKKYKFIVLNSLNQNAKPEGSEQAELGRLSPRAYPAPPACQPPMEPANLDLQSPTKLSASGEDSTIPQASRLNNIVNRSLAGSPRSSSESHSPLYMHPPKCTSCGSQSPQHTEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSAADLPPELPKAC

SEQ ID NO: 63 - DNA, 4264 bp, Rattus norvegicus
  CDS (1065)..(3188)
atcgtagggcgccgagcggcgcggccccgaggcattctacgggccgggagggcgccacggcgcgcggcgctgccacggagtcctcccctgctgtggagcaatggtaaagcccgcagctcaaattccgagaattgagctctgttgattcttagaactggggttcttagaagtggtgatgcaagaagtttctaggaaaggccggacaccagttttaaagcaaaattttggactgtgaagcaaggcattgggtgagtaaatcaaattatatgctctaaaatttgtaggtgaatttttcctcttgaatttttcccatgctgcggtgtgtgtgtgtgtgtgtgtgtgtgtgtgtgtgtgtgtgtgtgtgtgaagtttgccacttgatgaacaaaaggataatgaattctctccacacagagctcaggtctcacccctctgacccttcagtaactgacttcataccattgtatatgtgggattcttccttcccgttctcagttcaggttaacctggctgcctacactgctagcattatgcgagtgctaagcactcaaactattgaacgaaacaacccccagtctcagcgcatgggatgaacagtgaaatgacataccgattaaaaatagctgcactcattttttttttaaagaacctattatggtgtaggcacatatttctaattttaaaaaccacataggtattgccgttcctattttggaaagtgaaagcccagaaacagtaacagcgcactccaagtaacagagctggtgaaaggcaaagcaagctgggtgactctccaagagtggttttctccattgcaacacactctcaatgcttggcagggtgtttagtatgcggaaaagcacttcacgggcagcccttcccttcccctttcccctaaagagctttctacaccagccttcattctccctatttgacagctacgaaaaggaatgcccagaaaatgggctaggacttgtccactgtatacctgagtcgctacagcaggctcacctaggttcgcaaggagtaataggagttttaacttctgcccaggcaaacacaacatggcctcaccggctgacagctgtatccagttcacccgccatgctagtgatgttcttctcaaccttaaccgcctccgaagtcgggacatcttgaccgacgttgtcatcgtggtgagccgtgagcagtttagagcccataagacagtgctcatggcctgcagtggcctgttctacagcatcttcactgaccagttgaaatgcaaccttagtgtaatcaatctggatcctgagatcagccctgaggggttttgcatcctcttggacttcatgtacacatctaggctcaacctgagggaaggcaacatcatggccgtgatggccacagccatgtacctgcagatggagcatgttgtcgacacatgccggaagttcatcaaggccagtgaagcagaaatggcccctgcacttaagcctccccgtgaagagttcctgaacagccggatgctgatgccccatgacgtcatggcctatcgaggtcgtgaggttgtggagaacaatatgccactaagaaatactcccgggtgtgagagtagagcttttgcccctcccctgtacagtggcctgtcgacaccaccagcctcttatccgatgtatagccatctcccgctcagcagtttcctcttctccgacgaggaactacgagatgccccccgaatgcctgtggctaacccttttcccaaggagcgcgccctcccctgtgacagtgccaggccagtccctaatgagtatagcaggccaaccatggaggtgtcccccagcttgtgccacagcaatatctactcgcccaaggaggcagtcccagaggaggctcggagtgacatacactacagtgtgactgagggccccaagcctgctgccccttctgctcggcatgcctcgtacttcccctgtgacaaagccagcaaagaagaagagagaccctcttcagaggacgagatcgccctgcatttcgagccccccaatgcacccttgaaccggaagggtctggttagtccccagagtccgcagaaatccgactgccagcccaactcacccacagagtcctccagcagcaagaacgcctgcatccttcaggcctctggctctcctccagccaagagccccactgatccgaaagcctgcaactggaagaagtataagttcatcgttctcaacagcctcaatcagaatgccaagccagagggctctgagcaggcagagctgggccgcctctccccacgagcctaccctgcaccgccggcctgccagccgcctatggagcctgcgaaccttgatctccagtctccaaccaagctcagtgccagtggggaggactctaccatcccccaagccagccggctcaataacatcgttaacaggtccctggcaggctccccccgaagcagcagcgagagccactcgccactctacatgcaccccccgaagtgcacatcctgcggctctcagtccccacagcatacagagatgtgtctccatactgccgggcccacattcccggaggagatgggagagacccagtcagagtattcggattctagctgtgagaatggggccttcttctgcaatgaatgtgactgccgtttttctgaggaggcctcactcaagaggcacacgctgcagacgcacagtgacaaaccatacaaatgtgaccgctgccaggcctccttccgctacaaaggcaacctcgccagccacaagacggtccacacaggtgaaaaaccctaccgctgtaacatttgtggagcgcagttcaatcggccagccaacctgaagacccacactcgaattcactctggagaaaagccctacaaatgtgaaacctgtggggccagatttgtgcaggtggctcacctccgtgcccacgtgctcatccacactggagagaagccgtacccctgtgaaatctgtggtacccgcttcaggcaccttcagactctaaagagccatctgcgcatccacacaggagagaaaccgtaccattgtgagaagtgtaacctgcactttcgtcacaaaagccaactgcgacttcatttgcgtcagaaacatggcgccatcaccaacaccaaggtgcaataccgtgtgtcggccgctgatttgcctccggagctccccaaagcctgctgaagcatggagtgttgactctttttctctccagccccttctcagaatctacccaaaggatgctgtaacactttacaaaggtcatcccatgacgtagtgcctctctcatccactagagcaaatcatagttggggtgggggtgggggtgggggtggggtttgcgggaccgggagccaaggcagctctccttcccacactgccataaaacattaagaaaatactatcgcttcttctcctatgtgtaaggcaaaccacgtcagcaaaaatgcaaaatcattttcaatatcaaaataggggagaacgcagaagttctgacttgacaggttgcaacatgaggaatgtaaatgttctgtggggacagagatctcttttgtatgtaaatgtgcattgttttaaaagacaagacttcagtatgttgtcaaagagagggctttaattttttaaccaaaggtgaaggaatatatggcagagttgtaaatatataaatatatatatatataatataaatatataaacctaaaaagatatattgaaaatataaaactgtgttaaaggctcgattttgtatctgcaggcagacacggatctgagaatctttattgagaaagagcacttaagagactattttaagtattatgtctgtataagtaagaaaatattttgtctaaaatgcctccgtgtatttgtatttttttgcaagtgaaggtttacaatttacaaagtgtgtattaaaaacaaaaaagaacaaaaaaaagctgcagaaggagaaatgtatacttttgttctggttttcactttgtacatacctgtaaacgtgtcctcacggtgcctttttacacggaagttttcaatgatggacgggtgtgggccatccctttttgaagtgtaggcagacacagggacttgaagttgtcactaactaaactctctttgggaatgtttgactcctcccacattctgcgtcatgcttgttataattactccggagacagggtttggctgtgtctaaactgcattagtgcgttgtaaaatatagctgtatctgtataaaatataagaataaaacatggaaaagtcga

SEQ ID NO: 64 - protein, 707 aa, Rattus norvegicus; identical to SEQ ID NO: 62

SEQ ID NO: 65 - DNA, 3315 bp, Rattus norvegicus
  CDS (92)..(2215)
agtggtgatgcaagaagtttctaggaaaggccggacaccagttttaaagcaaaattttggactgtgaagcaaggcattgggcaaacacaacatggcctcaccggctgacagctgtatccagttcacccgccatgctagtgatgttcttctcaaccttaaccgcctccgaagtcgggacatcttgaccgacgttgtcatcgtggtgagccgtgagcagtttagagcccataagacagtgctcatggcctgcagtggcctgttctacagcatcttcactgaccagttgaaatgcaaccttagtgtaatcaatctggatcctgagatcagccctgaggggttttgcatcctcttggacttcatgtacacatctaggctcaacctgagggaaggcaacatcatggccgtgatggccacagccatgtacctgcagatggagcatgttgtcgacacatgccggaagttcatcaaggccagtgaagcagaaatggcccctgcacttaagcctccccgtgaagagttcctgaacagccggatgctgatgccccatgacgtcatggcctatcgaggtcgtgaggttgtggagaacaatatgccactaagaaatactcccgggtgtgagagtagagcttttgcccctcccctgtacagtggcctgtcgacaccaccagcctcttatccgatgtatagccatctcccgctcagcagtttcctcttctccgacgaggaactacgagatgccccccgaatgcctgtggctaacccttttcccaaggagcgcgccctcccctgtgacagtgccaggccagtccctaatgagtatagcaggccaaccatggaggtgtcccccagcttgtgccacagcaatatctactcgcccaaggaggcagtcccagaggaggctcggagtgacatacactacagtgtgactgagggccccaagcctgctgccccttctgctcggcatgcctcgtacttcccctgtgacaaagccagcaaagaagaagagagaccctcttcagaggacgagatcgccctgcatttcgagccccccaatgcacccttgaaccggaagggtctggttagtccccagagtccgcagaaatccgactgccagcccaactcacccacagagtcctccagcagcaagaacgcctgcatccttcaggcctctggctctcctccagccaagagccccactgatccgaaagcctgcaactggaagaagtataagttcatcgttctcaacagcctcaatcagaatgccaagccagagggctctgagcaggcagagctgggccgcctctccccacgagcctaccctgcaccgccggcctgccagccgcctatggagcctgcgaaccttgatctccagtctccaaccaagctcagtgccagtggggaggactctaccatcccccaagccagccggctcaataacatcgttaacaggtccctggcaggctccccccgaagcagcagcgagagccactcgccactctacatgcaccccccgaagtgcacatcctgcggctctcagtccccacagcatacagagatgtgtctccatactgccgggcccacattcccggaggagatgggagagacccagtcagagtattcggattctagctgtgagaatggggccttcttctgcaatgaatgtgactgccgtttttctgaggaggcctcactcaagaggcacacgctgcagacgcacagtgacaaaccatacaaatgtgaccgctgccaggcctccttccgctacaaaggcaacctcgccagccacaagacggtccacacaggtgaaaaaccctaccgctgtaacatttgtggagcgcagttcaatcggccagccaacctgaagacccacactcgaattcactctggagaaaagccctacaaatgtgaaacctgtggggccagatttgtgcaggtggctcacctccgtgcccacgtgctcatccacactggagagaagccgtacccctgtgaaatctgtggtacccgcttcaggcaccttcagactctaaagagccatctgcgcatccacacaggagagaaaccgtaccattgtgagaagtgtaacctgcactttcgtcacaaaagccaactgcgacttcatttgcgtcagaaacatggcgccatcaccaacaccaaggtgcaataccgtgtgtcggccgctgatttgcctccggagctccccaaagcctgctgaagcatggagtgttgactctttttctctccagccccttctcagaatctacccaaaggatgctgtaacactttacaaaggtcatcccatgacgtagtgcctctctcatccactagagcaaatcatagttggggtgggggtgggggtgggggtggggtttgcgggaccgggagccaaggcagctctccttcccacactgccataaaacattaagaaaatactatcgcttcttctcctatgtgtaaggcaaaccacgtcagcaaaaatgcaaaatcattttcaatatcaaaataggggagaacgcagaagttctgacttgacaggttgcaacatgaggaatgtaaatgttctgtggggacagagatctcttttgtatgtaaatgtgcattgttttaaaagacaagacttcagtatgttgtcaaagagagggctttaattttttaaccaaaggtgaaggaatatatggcagagttgtaaatatataaatatatatatatataatataaatatataaacctaaaaagatatattgaaaatataaaactgtgttaaaggctcgattttgtatctgcaggcagacacggatctgagaatctttattgagaaagagcacttaagagactattttaagtattatgtctgtataagtaagaaaatattttgtctaaaatgcctccgtgtatttgtatttttttgcaagtgaaggtttacaatttacaaagtgtgtattaaaaacaaaaaagaacaaaaaaaagctgcagaaggagaaatgtatacttttgttctggttttcactttgtacatacctgtaaacgtgtcctcacggtgcctttttacacggaagttttcaatgatggacgggtgtgggccatccctttttgaagtgtaggcagacacagggacttgaagttgtcactaactaaactctctttgggaatgtttgactcctcccacattctgcgtcatgcttgttataattactccggagacagggtttggctgtgtctaaactgcattagtgcgttgtaaaatatagctgtatctgtataaaatataagaataaaacatggaaaagtcgaaaaaaaaaaaaaaaaaaaaaaaaa

SEQ ID NO: 66 - protein, 707 aa, Rattus norvegicus; identical to SEQ ID NO: 62

SEQ ID NO: 67 - DNA, 3326 bp, Mus musculus
  CDS (89)..(2212)
ggtgatgcaagaagtttctaggaaaggccggacaccagttttaaagcaaaattttggactgtgaagcaaggcactgggcaaacacaacatggcctccccggctgacagctgtatccagtttacccggcacgctagtgatgttcttctcaaccttaatcgcctccggagtcgggacatcttgacggacgttgtcatcgtggtgagccgtgagcagtttagagcccataagacagtgctcatggcctgcagcggcctgttctacagtatcttcactgaccagttgaaatgcaaccttagtgtaatcaatctagatcctgaaatcagccctgaggggttttgcatcctcctggacttcatgtacacatctaggctcaacctgagggaaggcaatatcatggcggtgatgaccacagccatgtacctgcagatggagcatgttgtcgacacatgcaggaagttcatcaaggccagtgaagcagaaatggcccctgcacttaaacctccccgtgaagagttcctgaacagccggatgctgatgccccatgacatcatggcctaccgaggtcgtgaggtcgtggagaacaatatgccactgagaaatactcccgggtgtgagagcagagcttttgctcctcctctgtacagtggcctgtcaacaccaccagcctcttatcccatgtacagccatctcccgctcagcaccttcctcttctctgatgaggagctccgagatgccccccgaatgcctgtggccaacccttttcccaaggagcgtgccctcccctgcgacagtgccaggcaagtccctaatgagtatagcaggccagccatggaggtgtcccccagtttgtgtcacagcaacatctactcgcccaaggaggcagtcccagaggaggctcggagtgacatacactacagtgtgcctgagggccccaagcctgctgtcccttctgctcggaatgctccatacttcccctgtgacaaagccagcaaagaagaagagagaccttcttcggaggatgagattgccctgcatttcgagccccccaatgcacccttgaaccggaagggtctggttagtccccagagtccccagaaatccgactgccagcccaactcacccacagagtcctgcagcagcaagaacgcctgcatccttcaggcctctggctctccgccagccaagagccccactgacccgaaagcctgcaactggaagaagtataagttcatcgttctcaacagcctcaatcagaatgccaaacccgagggctctgagcaggcagagctgggtcgcctctcccctcgagcctaccctgcaccgcccgcttgccagccgcctatggagcccgcgaaccttgatctccagtccccgaccaagctcagtgccagtggggaggactctaccatcccccaagccagccggctcaataatctcgtgaacaggtccctggcaggctccccccgaagcagcagtgagagtcactcaccactctacatgcaccccccaaagtgcacatcctgcggctctcagtccccacagcatacagagatgtgcctccatactgctgggcccacgttcccggaggagatgggggaaacccagtcagagtattcggattctagctgtgagaatgggaccttcttctgcaacgaatgtgactgccgtttctctgaggaggcctcgctcaagaggcacacgctgcagacgcacagtgacaaaccatacaaatgtgatcgctgccaggcctccttccgctacaagggcaacctcgccagccacaagactgtccacacgggtgagaaaccctatcgctgtaacatttgtggagcgcagttcaatcggccagccaacctgaagacccacactcgaattcactctggagaaaagccctacaaatgtgaaacctgtggggccaggtttgttcaggtggcccacctccgtgcccacgtgctcatccacactggagagaagccgtacccctgtgaaatctgtggcactcgcttccggcaccttcagactctgaagagccatctgcgcatccacacaggagagaaaccttaccattgtgagaagtgtaacctgcactttcgtcacaaaagccaactgcgacttcatttgcgccagaagcacggcgccatcaccaacaccaaggtgcaataccgcgtgtcggccgctgacctgcctccggagctccccaaagcctgctgaatgaagcatggagtgttcctcgccctttcctctccagccccttctcagaatctacccaaaggatgctgtaacactttatacaaaggtcatcccatgatgtagtgcctctctcatccactagtgcaaatcatagttggggtgggggtgggggtggggtttgcgggaccgggagccaaggcagctccccttcccacactgccataaaacattaagaaaatactattgcttcttctcctatgtgtaaggcaaaccctgtcagcaaaaagcaaattcattttctatatcaaagtaggggagaatgcagaagttctgacttgacaggttgcaaccgaggaatgtaaatgatgtgtgggaacagaggtctcttttgtatgtaaatgtgtattgttttaaaagacaagacttcagtatgctgtcaaagagaaggctttaatttttttaaccaaaggtgaaggaatatatggcagagttgtaaatatataaatatatatatatataatataaatatataaacctaaaaagatatattgaaaatataaaactgtgttaaaggctcgattttgtatctgcaggcagacacggatctgagaatctttattgagaaagagcacttaagagactattttaagtattgcgtctgtataagtaagaaaatattttgtctaaaatgcctccgtgtatttgtatttttttgcaagtgaaggtttacaaatttacaaagtgtgtattaaaaacaaaaagaacaaaaaaaaaagctgcagaaggagaaatgtatacttttgttccagttttcagtttgtacatacctgtaatgtgtcctcacggtgcctttttacacggaagttttcaatgatggacgggtgtgcgccatccctttttgaagtgtaggcagacacagggacttgaagttgtcactaactaaactctctttgggaatgtttgactcctcccacattctgcgtcatgcttgtcgttataattactccggagacagggtttggctgtgtctaaactgcattagtgcgttgtaaaatagagctgtacaaaacataagaataaaacattgaaaagtcttgaaaaaaaaaaaaaaaaaaaaaaaaaaaaaaaaaaaaaa

SEQ ID NO: 68 - protein, 707 aa, Mus musculus
MASPADSCIQFTRHASDVLLNLNRLRSRDILTDVVIVVSREQFRAHKTVLMACSGLFYSIFTDQLKCNLSVINLDPEISPEGFCILLDFMYTSRLNLREGNIMAVMTTAMYLQMEHVVDTCRKFIKASEAEMAPALKPPREEFLNSRMLMPHDIMAYRGREVVENNMPLRNTPGCESRAFAPPLYSGLSTPPASYPMYSHLPLSTFLFSDEELRDAPRMPVANPFPKERALPCDSARQVPNEYSRPAMEVSPSLCHSNIYSPKEAVPEEARSDIHYSVPEGPKPAVPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGSEQAELGRLSPRAYPAPPACQPPMEPANLDLQSPTKLSASGEDSTIPQASRLNNLVNRSLAGSPRSSSESHSPLYMHPPKCTSCGSQSPQHTEMCLHTAGPTFPEEMGETQSEYSDSSCENGTFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSAADLPPELPKAC

SEQ ID NO: 69 - DNA, 3307 bp, Mus musculus
  CDS (111)..(2234)
gagaactggggttcttagaagtggtgatgcaagaagtttctaggaaaggccggacaccagttttaaagcaaaattttggactgtgaagcaaggcactgggcaaacacaacatggcctccccggctgacagctgtatccagtttacccggcacgctagtgatgttcttctcaaccttaatcgcctccggagtcgggacatcttgacggacgttgtcatcgtggtgagccgtgagcagtttagagcccataagacagtgctcatggcctgcagcggcctgttctacagtatcttcactgaccagttgaaatgcaaccttagtgtaatcaatctagatcctgaaatcagccctgaggggttttgcatcctcctggacttcatgtacacatctaggctcaacctgagggaaggcaatatcatggcggtgatgaccacagccatgtacctgcagatggagcatgttgtcgacacatgcaggaagttcatcaaggccagtgaagcagaaatggcccctgcacttaaacctccccgtgaagagttcctgaacagccggatgctgatgccccatgacatcatggcctaccgaggtcgtgaggtcgtggagaacaatatgccactgagaaatactcccgggtgtgagagcagagcttttgctcctcctctgtacagtggcctgtcaacaccaccagcctcttatcccatgtacagccatctcccgctcagcaccttcctcttctctgatgaggagctccgagatgccccccgaatgcctgtggccaacccttttcccaaggagcgtgccctcccctgcgacagtgccaggcaagtccctaatgagtatagcaggccagccatggaggtgtcccccagtttgtgtcacagcaacatctactcgcccaaggaggcagtcccagaggaggctcggagtgacatacactacagtgtgcctgagggccccaagcctgctgtcccttctgctcggaatgctccatacttcccctgtgacaaagccagcaaagaagaagagagaccttcttcggaggatgagattgccctgcatttcgagccccccaatgcacccttgaaccggaagggtctggttagtccccagagtccccagaaatccgactgccagcccaactcacccacagagtcctgcagcagcaagaacgcctgcatccttcaggcctctggctctccgccagccaagagccccactgacccgaaagcctgcaactggaagaagtataagttcatcgttctcaacagcctcaatcagaatgccaaacccgagggctctgagcaggcagagctgggtcgcctctcccctcgagcctaccctgcaccgcccgcttgccagccgcctatggagcccgcgaaccttgatctccagtccccgaccaagctcagtgccagtggggaggactctaccatcccccaagccagccggctcaataatctcgtgaacaggtccctggcaggctccccccgaagcagcagtgagagtcactcaccactctacatgcaccccccaaagtgcacatcctgcggctctcagtccccacagcatacagagatgtgcctccatactgctgggcccacgttcccggaggagatgggggaaacccagtcagagtattcggattctagctgtgagaatgggaccttcttctgcaacgaatgtgactgccgtttctctgaggaggcctcgctcaagaggcacacgctgcagacgcacagtgacaaaccatacaaatgtgatcgctgccaggcctccttccgctacaagggcaacctcgccagccacaagactgtccacacgggtgagaaaccctatcgctgtaacatttgtggagcgcagttcaatcggccagccaacctgaagacccacactcgaattcactctggagaaaagccctacaaatgtgaaacctgtggggccaggtttgttcaggtggcccacctccgtgcccacgtgctcatccacactggagagaagccgtacccctgtgaaatctgtggcactcgcttccggcaccttcagactctgaagagccatctgcgcatccacacaggagagaaaccttaccattgtgagaagtgtaacctgcactttcgtcacaaaagccaactgcgacttcatttgcgccagaagcacggcgccatcaccaacaccaaggtgcaataccgcgtgtcggccgctgacctgcctccggagctccccaaagcctgctgaatgaagcatggagtgttcctcgccctttcctctccagccccttctcagaatctacccaaaggatgctgtaacactttatacaaaggtcatcccatgatgtagtgcctctctcatccactagtgcaaatcatagttggggtgggggtgggggtggggtttgcgggaccgggagccaaggcagctccccttcccacactgccataaaacattaagaaaatactattgcttcttctcctatgtgtaaggcaaaccctgtcagcaaaaagcaaattcattttctatatcaaagtaggggagaatgcagaagttctgacttgacaggttgcaaccgaggaatgtaaatgatgtgtgggaacagaggtctcttttgtatgtaaatgtgtattgttttaaaagacaagacttcagtatgctgtcaaagagaaggctttaatttttttaaccaaaggtgaaggaatatatggcagagttgtaaatatataaatatatatatatataatataaatatataaacctaaaaagatatattgaaaatataaaactgtgttaaaggctcgattttgtatctgcaggcagacacggatctgagaatctttattgagaaagagcacttaagagactattttaagtattgcgtctgtataagtaagaaaatattttgtctaaaatgcctccgtgtatttgtatttttttgcaagtgaaggtttacaaatttacaaagtgtgtattaaaaacaaaaagaacaaaaaaaaaagctgcagaaggagaaatgtatacttttgttccagttttcagtttgtacatacctgtaatgtgtcctcacggtgcctttttacacggaagttttcaatgatggacgggtgtgcgccatccctttttgaagtgtaggcagacacagggacttgaagttgtcactaactaaactctctttgggaatgtttgactcctcccacattctgcgtcatgcttgtcgttataattactccggagacagggtttggctgtgtctaaactgcattagtgcgttgtaaaatagagctgtacaaaacataagaataaaacattgaaaagtc

SEQ ID NO: 70 - protein, 707 aa, Mus musculus; identical to SEQ ID NO: 68

SEQ ID NO: 71 - DNA, 3289 bp, Mus musculus
  CDS (113)..(2236)
gttagaactggggttcttagaagtggtgatgcaagaagtttctaggaaaggccggacaccagttttaaagcaaaattttggactgtgaagcaaggcactgggcaaacacaacatggcctccccggctgacagctgtatccagtttacccggcacgctagtgatgttcttctcaaccttaatcgcctccggagtcgggacatcttgacggacgttgtcatcgtggtgagccgtgagcagtttagagcccataagacagtgctcatggcctgcagcggcctgttctacagtatcttcactgaccagttgaaatgcaaccttagtgtaatcaatctagatcctgaaatcagccctgaggggttttgcatcctcctggacttcatgtacacatctaggctcaacctgagggaaggcaatatcatggcggtgatgaccacagccatgtacctgcagatggagcatgttgtcgacacatgcaggaagttcatcaaggccagtgaagcagaaatggcccctgcacttaaacctccccgtgaagagttcctgaacagccggatgctgatgccccatgacatcatggcctaccgaggtcgtgaggtcgtggagaacaatatgccactgagaaatactcccgggtgtgagagcagagcttttgctcctcctctgtacattggcctgtcaacaccaccagcctcttatcccatgtacagccatctcccgctcagcaccttcctcttctctgatgaggagctccgagatgccccccgaatgcctgtggccaacccttttcccaaggagcgtgccctcccctgcgacagtgccaggcaagtccctaatgagtatagcaggccagccatggaggtgtcccccagtttgtgtcacagcaacatctactcgcccaaggaggcagtcccagaggaggctcggagtgacatacactacagtgtgcctgagggccccaagcctgctgtcccttctgctcggaatgctccatacttcccctgtgacaaagccagcaaagaagaagagagaccttcttcggaggatgagattgccctgcatttcgagccccccaatgcacccttgaaccggaagggtctggttagtccccagagtccccagaaatccgactgccagcccaactcacccacagagtcctgcagcagcaagaacgcctgcatccttcaggcctctggctctccgccagccaagagccccactgacccgaaagcctgcaactggaagaagtataagttcatcgttctcaacagcctcaatcagaatgccaaacccgagggctctgagcaggcagagctgggtcgcctctcccctcgagcctaccctgcaccgcccgcttgccagccgcctatggagcccgcgaaccttgatctccagtccccgaccaagctcagtgccagtggggaggactctaccatcccccaagccagccggctcaataatctcgtgaacaggtccctggcaggctccccccgaagcagcagtgagagtcactcaccactctacatgcaccccccaaagtgcacatcctgcggctctcagtccccacagcatacagagatgtgcctccatactgctgggcccacgttcccggaggagatgggggaaacccagtcagagtattcggattctagctgtgagaatgggaccttcttctgcaacgaatgtgactgccgtttctctgaggaggcctcgctcaagaggcacacgctgcagacgcacagtgacaaaccatacaaatgtgatcgctgccaggcctccttccgctacaagggcaacctcgccagccacaagactgtccacacgggtgagaaaccctatcgctgtaacatttgtggagcgcagttcaatcggccagccaacctgaagacccacactcgaattcactctggagaaaagccctacaaatgtgaaacctgtggggccaggtttgttcaggtggcccacctccgtgcccacgtgctcatccacactggagagaagccgtacccctgtgaaatctgtggcactcgcttccggcaccttcagactctgaagagccatctgcgcatccacacaggagagaaaccttaccattgtgagaagtgtaacctgcactttcgtcacaaaagccaactgcgacttcatttgcgccagaagcacggcgccatcaccaacaccaaggtgcaataccgcgtgtcggccgctgacctgcctccggagctccccaaagcctgctgaatgaagcatggagtgttcctcgccctttcctctccagccccttctcagaatctacccaaaggatgctgtaacactttatacaaaggtcatcccatgatgtagtgcctctctcatccactagtgcaaatcatagttggggtgggggtgggggtggggtttgcgggaccgggagccaaggcagctccccttcccacactgccataaaacattaagaaaatactattgcttcttctcctatgtgtaaggccaaaccctgtcagcaaaaagcaaattcattttctatatcaaagtaggggagaatgcacaagttctgacttgaccaggttgcaaccgaggaatgtaaatgatgtgtgggaacagaggtctcttttgtatgtaaatgtgtattgttttaaaagacaagacttcagtatgctgtcaaagagaaggctttaatttttttaaccaaaggtgaaggaatatatggcagagttgtaaatatataaatatatatatatataatataaatatataaacctaaaaagatatattgaaaatataaaactgtgttaaaggctcgattttgtatctgcaggcagacacggatctgagaatctttattgagaaagagcacttaagagactattttaagtattgcgtctgtataagtaagaaaatattttgtctaaaatgcctccgtgtatttgtatttttttgcaagtgaaggtttacaaatttacaaagtgtgtattaaaaacaaaaagaacaaaaaaaaaagctgcagaaggagaaatgtatacttttgttccagttttcagtttgtacatacctgtaatgtgtcctcacggtgcctttttacacggaagttttcaatgatggacgggtgtgcgccatccctttttgaagtgtaggcagacacagggacttgaagttgtcactaactaaactctctttgggaatgtttgactcctcccacattctgcgtcatgcttgtcgttataattactccggagacagggtttggctgtgtctaaactgcattagtgcgttgtaaaatagagctgtacaaaacat

SEQ ID NO: 72 - protein, 707 aa, Mus musculus
MASPADSCIQFTRHASDVLLNLNRLRSRDILTDVVIVVSREQFRAHKTVLMACSGLFYSIFTDQLKCNLSVINLDPEISPEGFCILLDFMYTSRLNLREGNIMAVMTTAMYLQMEHVVDTCRKFIKASEAEMAPALKPPREEFLNSRMLMPHDIMAYRGREVVENNMPLRNTPGCESRAFAPPLYIGLSTPPASYPMYSHLPLSTFLFSDEELRDAPRMPVANPFPKERALPCDSARQVPNEYSRPAMEVSPSLCHSNIYSPKEAVPEEARSDIHYSVPEGPKPAVPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGSEQAELGRLSPRAYPAPPACQPPMEPANLDLQSPTKLSASGEDSTIPQASRLNNLVNRSLAGSPRSSSESHSPLYMHPPKCTSCGSQSPQHTEMCLHTAGPTFPEEMGETQSEYSDSSCENGTFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSAADLPPELPKAC

SEQ ID NO: 73 - DNA, 4894 bp, Homo sapiens
  CDS (21)..(2387)
cgccgcgggaggcggacgagatgcgagcgcggccgcggccccggccgctctgggcgactgtgctggcgctgggggcgctggcgggcgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgttctaaagtagagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgaatgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacagccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttggggctcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataagctgagctccttagcctttgtcccagaatgcctcctgcagggattcttcctgcttagcttgagggtgactatggagctgagcaggtgttcttcattacctcagtgagaagccagctttcctcatcaggccattgtccctgaagagaagggcagggctgaggcctctcattccagaggaagggacaccaagccttggctctaccctgagttcataaatttatggttctcaggcctgactctcagcagctatggtaggaactgctgggcttggcagcccgggtcatctgtacctctgcctcctttcccctccctcaggccgaaggaggagtcagggagagctgaactattagagctgcctgtgccttttgccatcccctcaacccagctatggttctctcgcaagggaagtccttgcaagctaattctttgacctgttgggagtgaggatgtctgggccactcaggggtcattcatggcctgggggatgtaccagcatctcccagttcataatcacaacccttcagatttgccttattggcagctctactctggaggtttgtttagaagaagtgtgtcacccttaggccagcaccatctctttacctcctaattccacaccctcactgctgtagacatttgctatgagctggggatgtctctcatgaccaaatgcttttcctcaaagggagagagtgctattgtagagccagaggtctggccctatgcttccggcctcctgtccctcatccatagcacctccacatacctggccctgtgccttggtgtgctgtatccatccatggggctgattgtatttaccttctacctcttggctgccttgtgaaggaattattcccatgagttggctgggaataagtgccaggatggaatgatgggtcagttgtatcagcacgtgtggcctgttcttctatgggttggacaacctcattttaactcagtctttaatctgagaggccacagtgcaattttattttatttttctcatgatgaggttttcttaacttaaaagaacatgtatataaacatgcttgcattatatttgtaaatttatgtgatggcaaagaaggagagcataggaaaccacacagacttgggcagggtacagacactcccacttggcatcattcacagcaagtcactggccagtggctggatctgtgaggggctctctcatgatagaaggctatggggatagatgtgtggacacattggacctttcctgaggaagagggactgttcttttgtcccagaaaagcagtggctccattggtgttgacatacatccaacattaaaagccacccccaaatgcccaagaaaaaaagaaagacttatcaacatttgttccatgagcagaaaactggagctctggcctcagtgttacagctaaataatctttaattaaggcaagtcactttcttcttcttaaagctgttttctagtttgagaaatgatgggattttagcagccagtcttgaaggtctctttcagtatcaacattctaagatgctgggacttactgtgtcatcaaatgtgcggttaagattctctgggatattgatactgtttgtgtttttagttgggagatctgagagacctggctttggcaagagcagatgtcattccatatcacctttctcaatgaaagtctcattctatcctctctccaaacccgttttccaacatttgttaatagttacgtctctcctgatgtagcacttaagcttcatttagttattatttctttcttcactttgcacacatttgcatccacatattagggaagaggaatccataagtagctgaaatatctattctgtattattgtgttaacattgagaataagccttggaattagatatggggcaatgactgagccctgtctcacccatggattactccttactgtagggaatggcagtatggtagagggataaatagggggcggggagggatagtcatggatccaagaagtccttagaaatagtggcagggaacaggtgtggaagctcatgcctgtaattataaccttcagctactaagacaggtgtggtggctcacgcctgtgattataatcttcagttactaagacagagtccatgagagtgttaatgggacattttctttagataagatgttttatatgaagaaactgtatcaaagggggaagaaaatgtatttaacaggtgaatcaaatcaggaatcttgtctgagctactggaatgaagttcacaggtcttgaagacca

SEQ ID NO: 74 - protein, 788 aa, Homo sapiens
MRARPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 75 - DNA, 4428 bp, Homo sapiens
  CDS (19)..(2385)
ccgcgggaggcggacgagatgcgagcgcggccgcggccccggccgctctgggtgactgtgctggcgctgggggcgctggcgggcgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgttctaaagtcgagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgagtgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacagccaacaacccactgtataaagaggccacgtctaccttcaccaatatcacgtaccggggcacttaatgataagcagtcatcctcagatcattatcagcctgtgccaggattgcaggagtccctgccatcatgtttacagaggacagtatttgtggggagggatttcggggctcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataagctgagctccttagcctttgtcccagaatgcctcctgcagggattcttcctgcttagcttgagggtgactatggagctgagcaggtgttcttcattacctcagtgagaagccagctttcctcatcaggccattgtccctgaagagaagggcagggctgaggcctctcattccagaggaagggacaccaagccttggctctaccctgagttcataaatttatggttctcaggcctgactctcagcagctatggtaggaactgctggcttggcagcccgggtcatctgtacctctgcctcctttcccctccctcaggccgaaggaggagtcagggagagctgaactattagagctgcctgtgccttttgccatcccctcaacccagctatggttctctcgcaagggaagtccttgcaagctaattctttgacctgttgggagtgaggatgtctgggccactcaggggtcattcatggcctgggggatgtaccagcatctcccagttcataatcacaacccttcaaagatttgccttattggcagctctactctggaggtttgtttagaagaagtgtgtcacccttaggccagcaccatctctttacctcctaattccacaccctcactgctgtagacatttgctatgacctggggatgtctctcatgaccaaatgcttttcctcaaagggagagagtgctattgtagagccagaggtctggccctatgcttccggcctcctgtccctcatccatagcacctccacatacctggccctgagccttggtgtgctgtatccatccatggggctgattgtatttaccttctacctcttggctgccttgtgaaggaattattcccatgagttggctgggaataagtgccaggatggaatgatgggtcagttgtatcagcacgtgtggcctgttcttctatgggttacaacctcatttaactcagtctttaatctgagaggccacagtgcaattttattttatttttctcatgatgaggttttcttaacttaaaagaacatgtatataaacatgcttgcattatatttgtaaatttatgtgtatggcaaagaaggagagcataggaaaccacacagacttgggcagggtacagacactcccacttggcatcattcacagcaagtcactggccagtggctggatctgtgaggggctctctcatgatagaaggctatggggatagatgtgtggacacattggacctttcctgaggaagagggactgttcttttgtcccagaaaagcagtggctccattggtgttgacatacatccaacattaaaagccacccccaaatgcccaagaaaaaaagaaagacttatcaacatttgttccatgagcagaaaactggagctctggcctcagtgttacagctaaataatctttaattaaggcaagtcactttcttcttcttaaagctgtttctagtttgagaaatgatgggattttagcagccagtcttgaaggtctctttcagtatcaacattctaagatgctgggacttactgtgtcatcaaatgtgcggttaagattctctgggatattgatactgtttgtgtttttagttgggagatctgagagacctggctttggcaagagcagatgtcattccatatcacctttctcaatgaaagtctcattctatcctctctccaaacccgttttccaacatttgttaatagttacgtctctcctgatgtagcacttaagcttcatttagttattatttctttcttcactttgcacacatttgcatccacatattagggaa

SEQ ID NO: 76 - protein, 788 aa, Homo sapiens [sequence omitted]

SEQ ID NO: 77 - DNA, 5918 bp, Gorilla gorilla gorilla
  CDS (22)..(2388)
gcgccgcgggaggcggacgagatgcgagcgcggccgcggccccggccgttctgggcgactgtgctggcgctgggggcgctggcgggtgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcaaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcccaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgctctaaagtcgagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaagagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgagtgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaagctcctcatcaccatccatgaccgaaaagagttcgctaaatttgaggaagaacgcgccagagcaaaatgggacacagccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttggggctcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataagctgagctccttagcctttgtcccagaatgcctcctgcagggtttcttcctgcttagcttgagggtgactatggagttgagcaggtgttcttcattacctcagtgagaagccagctttcctcatcaggccattgtccctgaagagaagggcagggctgaggcctctcattccagaggaagggacaccaagccttggctctaccctgagttcataaatttatggttctcaggcctgactctcagcagctatggtaggaactgctgggcttggcagcccgggtcatctgtacctctgcctcctttcccctccgtcaggccgaaggaggagtcagggagagctgaactattagagctgcctgtgccttttgccatcccctcaacccagctatggttctctcgcaagggaagtccttgcaagctaattctttgacctgttgggagtgaggatgtctgggccactcaggggtcattcatggcctgggggatgtaccagcatctcccagttcataatcacaacccttcagatttgccttattggcagctctactctggaggtttgtttagaagaagtgtgtcacccttaggccagcaccatctctttacctcctaattccacaccctcactgctgtagacatttgctatgagctggggatgtctctcatgaccaaatgcttttcctcaaagggagagagtgctattgtagagccagaggtctggccctatgcttccggcctcctgtccctcatcaatagcacctccatatacccggccctgtgccttggtgtgctgtatccatccatggggctgattgtatttaccttctacctcttggctgccttgtgaaggaattattcccatgagttggctgggaataagtgccaggatggaatgatgggtcagttgtatcagcatgtgtggcctgttcttctatgggttggacaacctcattttaactcagtctttaatctgagaggccacagtgcaattttattttatttttctcatgatgaggttttcttaacttaaaagaacatgtatataaacatgcttacattatatttgtaaatttatgtgatggcaaagaaggagagcataggaaaccacacagacttgggcagggtacagacactcccacttggcatcattcacagcaagtcactggccagtggctggatctgtgaggggctctctcatgatagaaggctatggggatacatgtgtggacacattggacctttcctgaggaagagggactgttcttttgtcccagaaaagcagtggctccattggtgttgacatacatccaacattaaaagccacccccaaatgcccaagaaaaaaagaaagacttatcaacatttgttccatgagcagaaaactggagctctggcctcagtgttacagctaaataatctttaattaaggcaagtcactttcttcttcttaaggctgttttctagtttgagaaatgatgggattttagcagccagtcttgaaggtctctttcagtatcaacattctaagatgctgggacttactgtggcatcaaatgtgtggttaagattctctgggatattgatactgtttgtgtttttagttgggagatctgagagacctggctttggcaagagcagatgtcattccatatcacctttctcaatgaaagtctcattctatcctctctccaaacccttttccaacatttgttaatagttacatctctcctgatgtagcacttaagcttcatttagttattatttctttcttcactttgcacacatttgcatccacatattagggaagaggaatccataagtagctgaaatatctattctgtattattgtgttaacattgagaataagccttggaattagatatggggcaatgactgagtcctgtctcacccatggattactccttactgtagggaatggcaatatggtagagggataaataggggacggggagggacagtcatggatccaagaagtccttagaaatagtggcagggaacaggtgtggcagctcatgcctgtaattataaccttcagctactaagacaggtgtggtggctcacacctgtgattataatcttcagttactaagagtccattagagtgttaatgggacattttctttagataagatgttttatatgaagaaactgtattaaagggggaagaaaatgtatttaacaggtgaatcaaatcaggaatcttgtctgagctactggaatgaagttcacaggtcttgaagaccaatattatttgtcaatatgtggggataacctgtagctgcattcatgaggtagcaaatagcagttttggcctgtggggtgaacagctaaacagtgttctggcatcagataccatggcacaaagggattgtgtctagctcttttggagaaaatttatgtccagtctcaggatctgtggacaataacggaaaactttgaatattcctgacaagttgccatattaggagtcagttctttacttctctgagattcccaggtcatccatgatttttttttaaatttgagacaaggcctcactcttgttgcccaagctggaatgcaatggcaagatctcggttcactgcaatctctgcctctcaggttcaagccattctcctgcctcagcctccccagtagctgggattacaggcacccgccaccacacccggctaatttttgtatttttagtagagacggggttttaccatgttggccaggctggtctcgaactcctgaccttaggcgatccaccttccttggcctcccaaagtgctgggattacaagtgtgagccactgtgcccggccagtcatccatgattttaatgtgggggtccaaaggcctctttttctttgttaagtattcctggttgaaatttcttttcttttttttttttgagacagagtcttgctctatcacccaggctggagtgcagtggcgcgatctctgctcactgcaagcttcgcctcccgggttcacaccattctcctgcctcagcctcccgagtagctgggattacaggcgcctgccaccatgcccggctaatttctttttgtatttttagtagagacggtttcacggtgttagccaggaacgtctcgacctcctgacctcgtgatcctcccgcctcggcctcccaaagtgctgggattacaggcgtgagccactgcccctggccgtggttgaaatttcttaagtgccttcctgacttcctaaccaccttctctgtttgggtttgtgcaacaataaattaaatgtactttccaaaaagaa

SEQ ID NO: 78 - protein, 788 aa, Gorilla gorilla gorilla
MRARPRPRPFWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALKNPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 79 - DNA, 5129 bp, Chlorocebus sabaeus
  CDS (45)..(2411)
gcgcccactgtggggcgggcggagcgcggcgggaggcggacgagatgcgagcgcagccgcggccccggccgctctgggcaactgtgctggcgctgggggcgctggcgggcgttggcgtcggagggcccaacatctgtaccacgcgaggtgtgagctcctgccagcagtgtctggctgtgagccccatgtgtgcctggtgctctgatgaggccctgccgctgggctcacctcgctgtgacctgaaggagaatctgctgaaggataactgtgccccggaatccatcgagttcccagtcagtgaggcccgagtactagaggacaggcccctcagcgacaaaggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggacgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgtcgctaactgaccaggtgacccgcttcaatgaggaagtgaagaagcagagtgtgtcacggaaccgagatgctccagagggtggctttgatgccatcatgcaggctacagtctgtgatgaaaagattggctggaggaatgatgcatcacacttgctggtgtttaccactgatgccaagactcatatagcactggacggaaggctggcaggcattgtccagcccaatgatgggcagtgtcatgttggtagtgacaatcattactctgcctccactaccatggattatccctctttggggctgatgactgagaagctctcccagaaaaacatcaatttgatctttgcagtgactgaaaatgtagtcaatctctatcagaactatagtgagctcatcccagggaccacagtcggggttctgtccatggattccagcaatgtcctccagctcattgttgatgcttatgggaaaatccgctctaaagtcgagctggaagtgcgtgacctccctgaagaattgtctctatccttcaacgccacctgcctcaacaatgaggtcatccctggcctcaagtcttgtatgggactcaagattggagacacggtgagcttcagcattgaggccaaggtgcgaggctgcccccaggagaaggagaagtcctttaccatcaagcccgtgggcttcaaggacagcctgatcgtccaggtcacctttgattgcgactgtgcctgccaggcccaagctgaacctaatagccgtcactgcaacaatggcaatgggacctttgagtgtggggtgtgccgttgtgggcctggctggctgggatcccagtgtgagtgctcagaggaagactatcgcccttcccagcaggacgagtgcagcccccgggagggtcagcccgtctgcagccagcggggcgagtgtctctgtggtcaatgtgtctgccacagcagtgactttggcaagatcacgggcaagtactgcgagtgtgatgacttctcctgtgtccgctacaagggggagatgtgctcaggccatggccagtgcagctgtggggactgcctgtgtgactccgactggaccggctactactgcaactgcaccacacgtactgacacctgcatgtccagcaatgggctgctgtgcagcggccgtggcaagtgtaaatgtggcagctgtgtctgtatccagccgggctcctatggggacacctgtgagaagtgccctacctgcccagatgcctgcacctttaagaaagaatgcgtagagtgtaagaagtttgaccggggagccctacatgatgaaaatacctgcaaccgttactgccgcgatgagattgagtcagtgaaagagcttaaggacactggcaaggatgcagtgaattgtacctataagaatgaggatgactgtgtcgtcagattccagtactatgaagactctagtggaaagtccatcctgtatgtggtagaagagccagagtgtcccaagggccctgacatcctggtggtcctgctgtcagtgatgggggccattctgctcatcggccttgccactctgctcatctggaagctcctcatcaccatccacgaccgaaaagagtttgctaaatttgaggaagaacgcgccagagcaaaatgggacacagccaacaacccactgtataaagaggccacgtctaccttcaccaatatcacctaccggggcacttaatgataagcagtcatcctcagatcattatcagcctgtgccacgattgcaggagtctctgccatcatgtttacagaggacagtatttgtggggagggatttggggctcagagtggggtgggttgggagaatgtcagtatgtggaagtgtgggtctgtgtgtgtgtgtgtctgtgtgtgtgtgtgtgtgttgtgtgtgggagtgtgtaatttaaaattgtgatgtgtcctgataagccgagctccttagcctttgtccccagaatgcctcctgcaggggattcttcctgcttagcttgagggtgactatggagctgagcaggtgttcttcattacctcagtgagaagccagcttttctcatcaggccattgtccctgaagagaagggcaaggctgagacctctcattccagaggaggggacgccaaaccttggctctaccctgagttcataagtttatggttcttgggcctgactctcagcagctatagtaggaactgctgtgcttggcagcccaggtcatctgtacctctgcctcctttcccctccctcaggctgaaggaggagtcagggagagctgaactatcagagctgcctgtgccttttgccatcccctcaacccagctatggttctcttgcaagggaagtccttgcaacctaattctttgacctgttgggagtgaggatgtctgggtcactcagggtcattcatggcctgggggatgtaccagcatctcccagttcataatcacaacccttcagatttgccttattggcagctctactctggaggtttgtttagaagaagtgtgtcacccttagcccagcaccatctctttacctcctaattccacgccctcactgctgtagacatttgctatgagctggggatgtctctcatgaccaaatgcttttcctcaaagggagagagtgctattgtagagccagaggtctggccctacccttccggccttctgtccctcgttcatagcacctccacatacccagccctgtgccttggtgtgctgtatcgacccatggggctgattgtatttacctactacctcttggctgccttgtgaaggaattattcccatgagttggctgggaataagtgccaggatggaatgatgggtcggttgtaccagcatgtgtggcctgttctatgggttggacaacctcattttaactcagtctttaatctgagaggccacagtgcaattttattttatttttctcatgatgaggttttttaacctaaaggaatatgtatataaacatgcttgcgttatgtttgtaaatttatatgatggcaaagaaggagagcataggaagccacacagacttgggcagggtacagacactcccacttggcatcattcacagcaagtcactggccagtggctggatctgtgagtggctctctcatgatagaaggctatagggatagatgtatggacacattggacccttcctgaggaggagggactgttcttttgtctcagaaaagcagtggctccgttggtgttgacatacatccaacattaaaagccacccccaatcgcccaagagaaaaagaaacaaccttatcaacagttgttccatgagcagaaaacaggagttctgatctcagtgttgcagctaaataatctttaactctaattaaggcaagtcactttcttcttcttaaggctgttttctagtttgagaaatgggttttgagcagccagtcttgaaggtctctttcagtatcaacattctaagatgctgggacttactgtggcatcaaatgtgtggtcaagattctgtgggatattgatactgtgtgtgttttcagttgggagatctgagagacctggctttggcaagagcagatgtcattccatatcacctttctcaatgaaagtctcattctatcctctctccaaaccccttttccaacatttgttaatagttacatctctcctgatgtagcacttaagcttcatttagctattatttctttcttcactttgcacacatttgcatccacatattagggaaaaggaatccataagcagctgaaatatctattctgtattcttgtgttaacattgagaataagccttggaattagatatggggcaatggctgagccttgtctcacccatagattactccttactgtagggaatgggaatgtggtagaggcgtaaataggggacggggagggatagtcatggatccaagaagtctagaacctaattagcaccttcagttactaagacagagtccatgagaatcttaatgggacattttctttagataacatgttttatatgaataaattgtatcaaagcgggaaggaaatgtatttaaagggtgaatcaaatcaggaatcttgcctgagccactggaatgaagttcacaggtcttgaagaccagtactatttgtcagtatgtggggataacctgtagctgcattcatgaggtagcaaatagcagttttggcctgtggggtgaacagttaaacagtgttctggcatcagataacacagcacaaagggattgtgtctagctcttttggagaaaatttatgtctagtctcaggagctgtggacaataatgggaaactttgaatattcctgacaagttgccatattaggagtcagttctttacttctctgatattcctatgtcatccatgattttttttttttttttttttttttttttttaatttt

SEQ ID NO: 80 - protein, 788 aa, Chlorocebus sabaeus
MRAQPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLSLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSRHCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCKCGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 81 - DNA, 3769 bp, Chlorocebus sabaeus
  CDS (269)..(2494)
catcagccaggctgagagccttcccggccgccgcggcgctcacggtgccgtgggcttatctctgagtccggcgatcagcccgggctacgcgcgtcgttggtggtcccggtcgggccaaggactactggcccaggagccaaggcgaggtggggcttccggggattgttcccgggccttggcagagggatgccgccgtagcttcccggggcccaacatctgtaccacgcgaggtgtgagctcctgccagcagtgtctggctgtgagccccatgtgtgcctggtgctctgatgaggccctgccgctgggctcacctcgctgtgacctgaaggagaatctgctgaaggataactgtgccccggaatccatcgagttcccagtcagtgaggcccgagtactagaggacaggcccctcagcgacaaaggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggacgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgtcgctaactgaccaggtgacccgcttcaatgaggaagtgaagaagcagagtgtgtcacggaaccgagatgctccagagggtggctttgatgccatcatgcaggctacagtctgtgatgaaaagattggctggaggaatgatgcatcacacttgctggtgtttaccactgatgccaagactcatatagcactggacggaaggctggcaggcattgtccagcccaatgatgggcagtgtcatgttggtagtgacaatcattactctgcctccactaccatggattatccctctttggggctgatgactgagaagctctcccagaaaaacatcaatttgatctttgcagtgactgaaaatgtagtcaatctctatcagaactatagtgagctcatcccagggaccacagtcggggttctgtccatggattccagcaatgtcctccagctcattgttgatgcttatgggaaaatccgctctaaagtcgagctggaagtgcgtgacctccctgaagaattgtctctatccttcaacgccacctgcctcaacaatgaggtcatccctggcctcaagtcttgtatgggactcaagattggagacacggtgagcttcagcattgaggccaaggtgcgaggctgcccccaggagaaggagaagtcctttaccatcaagcccgtgggcttcaaggacagcctgatcgtccaggtcacctttgattgcgactgtgcctgccaggcccaagctgaacctaatagccgtcactgcaacaatggcaatgggacctttgagtgtggggtgtgccgttgtgggcctggctggctgggatcccagtgtgagtgctcagaggaagactatcgcccttcccagcaggacgagtgcagcccccgggagggtcagcccgtctgcagccagcggggcgagtgtctctgtggtcaatgtgtctgccacagcagtgactttggcaagatcacgggcaagtactgcgagtgtgatgacttctcctgtgtccgctacaagggggagatgtgctcaggccatggccagtgcagctgtggggactgcctgtgtgactccgactggaccggctactactgcaactgcaccacacgtactgacacctgcatgtccagcaatgggctgctgtgcagcggccgtggcaagtgtaaatgtggcagctgtgtctgtatccagccgggctcctatggggacacctgtgagaagtgccctacctgcccagatgcctgcacctttaagaaagaatgcgtagagtgtaagaagtttgaccggggagccctacatgatgaaaatacctgcaaccgttactgccgcgatgagattgagtcagtgaaagagcttaaggacactggcaaggatgcagtgaattgtacctataagaatgaggatgactgtgtcgtcagattccagtactatgaagactctagtggaaagtccatcctgtatgtggtagaagagccagagtgtcccaagggccctgacatcctggtggtcctgctgtcagtgatgggggccattctgctcatcggccttgccactctgctcatctggaagctcctcatcaccatccacgaccgaaaagagtttgctaaatttgaggaagaacgcgccagagcaaaatgggacacagccaacaacccactgtataaagaggccacgtctaccttcaccaatatcacctaccggggcacttaatgataagcagtcatcctcagatcattatcagcctgtgccacgattgcaggagtctctgccatcatgtttacagaggacagtatttgtggggagggatttggggctcagagtggggtgggttgggagaatgtcagtatgtggaagtgtgggtctgtgtgtgtgtgtgtctgtgtgtgtgtgtgtgtgttgtgtgtgggagtgtgtaatttaaaattgtgatgtgtcctgataagccgagctccttagcctttgtccccagaatgcctcctgcaggggattcttcctgcttagcttgagggtgactatggagctgagcaggtgttcttcattacctcagtgagaagccagcttttctcatcaggccattgtccctgaagagaagggcaaggctgagacctctcattccagaggaggggacgccaaaccttggctctaccctgagttcataagtttatggttcttgggcctgactctcagcagctatagtaggaactgctgtgcttggcagcccaggtcatctgtacctctgcctcctttcccctccctcaggctgaaggaggagtcagggagagctgaactatcagagctgcctgtgccttttgccatcccctcaacccagctatggttctcttgcaagggaagtccttgcaacctaattctttgacctgttgggagtgaggatgtctgggtcactcagggtcattcatggcctgggggatgtaccagcatctcccagttcataatcacaacccttcagatttgccttattggcagctctactctggaggtttgtttagaagaagtgtgtcacccttagcccagcaccatctctttacctcctaattccacgccctcactgctgtagacatttgctatgagctggggatgtctctcatgaccaaatgcttttcctcaaagggagagagtgctattgtagagccagaggtctggccctacccttccggccttctgtccctcgttcatagcacctccacatacccagccctgtgccttggtgtgctgtatcgacccatggggctgattgtatttacctactacctcttggctgccttgtgaaggaattattcccatgagttggctgggaataagtgccaggatggaatgatgggtcggttgtaccagcatgtgtggcctgttctatgggttggacaacctcattttaactcagtctttaatctgagaggccacagtgcaattttattttatttttctcatgatgaggttttttaacctaaaggaatatgtatataaaca

SEQ ID NO: 82 - protein, 741 aa, Chlorocebus sabaeus
MCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLSLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSRHCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCKCGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 83 - DNA, 4072 bp, Macaca mulatta
  CDS (22)..(2388)
gctcggcgggaggcggacgagatgcgagcgcagcccgggccccggccgctctgggcaactgtgctggcgctgggggcgctggcgggcgttggcgtcggagggcccaacatctgtaccacacgaggtgtgagctcctgccagcagtgcctggctgtgagccccatgtgtgcctggtgctctgatgaggccctgcctctgggctcacctcgctgtgacctgaaggagaatctgctgaaggataactgtgccccggaatccatcgagttcccagtcagtgaggcccgagtactagaggacaggcccctcagcgacaaaggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggacgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgtcgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcgcacttgctggtgtttaccactgatgccaagactcatatagcactggacggaaggctggcaggcattgtccagcccaatgatgggcagtgtcatgttggtagtgacaatcattactctgcctccactaccatggattatccctctttggggctgatgactgagaagctctcccagaaaaacatcaatttgatctttgcagtgactgaaaatgtagtcaatctctatcagaactatagtgagctcatcccagggaccacagtcggggttctgtccatggattccagcaatgtcctccagctcattgttgatgcttatgggaaaatccgctctaaagtcgagctggaagtgcgtgacctccctgaagaattgtctctatccttcaacgccacctgcctcaacaatgaggtcatccctggcctcaagtcttgtatgggactcaagattggagacacggtgagcttcagcattgaggccaaggtgcgaggctgcccccaggagaaggagaagtcctttaccatcaagcccgtgggcttcaaggacagcctgatcgtccaggtcacctttgattgcgactgtgcctgccaggcccaagctgaacctaatagccgtcactgcaacaatggcaatgggacctttgagtgtggggtgtgccgttgtgggcctggctggctgggatcccagtgtgagtgctcagaggaggactatcgcccttcccagcaggacgagtgcagcccccgggagggtcagcccgtctgcagccagcggggcgagtgtctctgtggtcaatgtgtctgccacagcagtgactttggcaagatcacgggcaagtactgcgagtgtgatgacttctcctgtgtccgctacaagggggagatgtgctcaggccatggccagtgcagctgtggggactgcctgtgtgactccgactggaccggctactactgcaactgcaccacacgtactgatacctgcatgtccagcaatgggctgctgtgcagcggccgcggcaagtgtgaatgtggcagctgtgtctgtatccagccgggctcctatggggacacctgtgagaagtgccctacctgcccagatgcctgcacctttaagaaagaatgcgtagagtgtaagaagtttgaccggggagccctacatgatgaaaatacctgcaaccgttactgccgcgatgagattgagtcagtgaaagagcttaaggacactggcaaggatgcagtgaattgtacctataagaatgaggatgactgtgtcgtcagattccagtactatgaagactctagtggaaagtccatcctgtatgtggtagaagagccagagtgtcccaagggccctgacatcctggtggtcctgctgtcagtgatgggggccattctgctcatcggccttgccactctgctcatctggaagctcctcatcaccatccacgaccgaaaagagtttgctaaatttgaggaagaacgcgccagagcaaaatgggacacagccaacaacccactgtataaagaggccacgtctaccttcaccaatatcacctaccggggcacttaatgataagcagtcatcctcagatcattatcagcctgtgccacgattgcaggagtctccgccatcatgtttacagaggacagtatttgtggggagggatttggggctcagagtggggtgggttgggagaatgtcagtatgtggaagtgtgggtctgtgtgtgtgtgtgtgtctgtgtgtgtgtgtgtgtgtgttgtgtgtgggagtgtgtaatttaaaattgtgatgtgtcctgataagccgagctccttagcctttgtccctagaatgcctcctgcaggggattcttcctgcttagcttgagggtgactatggagctaagcaggtgttcttcattacctcagtgagaagccagcttttctcatcaggccattgtccctgaagagaagggcagggctgagacctctcattccagaggaagggacgccaaaccttggctctaccctgagttcataagtttatggttcttgggcctgactctcagcagctatagtaggaactgctgtgcttggcagcccaggtcatctgtacctctgcctcctttcccctccctcaggctgaaggaggagtcagggagagctgaactatcagagctgcctgtgccttttgccatcccctcaacccagctatgtttctctcgcaagggaagtccttgcaacctaattctttgacctgttgggagtgaggatgtccgggccactcagggtcattcatggcctgggggatgtaccagcatctcctagttcataatcacaacccttcagatttgccttattggcagctctactctggaggtttgtttagaagaagtgtgtcacccttaggccagcaccatctctttacctcctaattccacaccctcactgctgtagacatttgctatgagctggggatgtctctcatgaccaaatgcttttcctcaaagggagagagtgctattgtagagccagaggtctggcacccttccggccttctgtccctcgttcatagcacctccacatacccagccctgtgccttggtgtgctgtatccacccatggggctgattgtatttacctactacctcttggctgccttgtgaaggaattattcccatgagttggctgggaataagtgccaggatggaatgatgggtcagttgtaccagcatgtgtggcctgttcttctatgggttggacaacctcattttaactcagtctttaatctgagaggccacagtgcaattttattttatttttctcatgatgaggttttcttaacctaaaggaatatgtatataaacatgcttgcgttatgtttctaaatttatatgatggcaaagaaggagagcataggaagccacacagacttgggcagggtacagacactcccacttggcatcattcacagcaagtcactgtccagtggctgtatctgtgaggggctctctcatgatagaaggctatagggatagatgtatggacacattggacccttcctgaggaggagggactgttcttttgtctcagaaaagcagtggctccattggtgttgacatacatccaacattaaaagccacccccaatcgcccaagagaaaaagaaagccttatcaacagttgttccatgagcagaaaacaggagttctgatctcagtgttgcagctaaataatctttaactctaattaaggcaagtcactttcttcttc

SEQ ID NO: 84 - protein, 788 aa, Macaca mulatta
MRAQPGPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLSLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSRHCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 85 - DNA, 4480 bp, Macaca mulatta
  CDS (11)..(2377)
ggcggacgagatgcgagcgcagcccgggccccggccgctctgggcaactgtgctggcgctgggggcgctggcgggcgttggcgttgcagggcccaacatctgtaccacacgaggtgtgagctcctgccagcagtgcctggctgtgagccccatgtgtgcctggtgctctgatgaggccctgcctctgggctcacctcgctgtgacctgaaggagaatctgctgaaggataactgtgccccggaatccatcgagttcccagtcagtgaggcccgagtactagaggacaggcccctcagcgacaaaggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggacgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgtcgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcttcgcacttgctggtgtttaccactgatgccaagactcatatagcactggacggaaggctggcaggcattgtccagcccaatgatgggcagtgtcatgttggtagtgacaatcattactctgcctccactaccatggattatccctctttggggctgatgactgagaagctctcccagaaaaacatcaatttgatctttgcagtgactgaaaatgtagtcaatctctatcagaactatagtgagctcatcccagggaccacagtcggggttctgtccatggattccagcaatgtcctccagctcattgttgatgcttatgggaaaatccgctctaaagtcgagctggaagtgcgtgacctccctgaagaattgtctctatccttcaacgccacctgcctcaacaatgaggtcatccctggcctcaagtcttgtatgggactcaagattggagacacggtgagcttcagcattgaggccaaggtgcgaggctgcccccaggagaaggagaagtcctttaccatcaagcccgtgggcttcaaggacagcctgatcgtccaggtcacctttgattgcgactgtgcctgccaggcccaagctgaacctaatagccgtcactgcaacaatggcaatgggacctttgagtgtggggtgtgccgttgtgggcctggctggctaggatcccagtgtgagtgctcagaggaggactatcgcccttcccagcaggacgagtgcagcccccgggagggtcagcccgtctgcagccagcggggcgagtgtctctgtggtcaatgtgtctgccacagcagtgactttggcaagatcacgggcaagtactgcgagtgtgatgacttctcctgtgtccgctacaagggggagatgtgctcaggccatggccagtgcagctgtggggactgcctgtgtgactccgactggaccggctactactgcaactgcaccacacgtactgatacctgcatgtccagcaatgggctgctgtgcagcggccgcggcaagtgtgaatgtggcagctgtgtctgtatccagccgggctcctatggggacacctgtgagaagtgccctacctgcccagatgcctgcacctttaagaaagaatgcgtagagtgtaagaagtttgaccggggagccctacatgatgaaaatacctgcaaccgttactgccgcgatgagattgagtcagtgaaagagcttaaggacactggcaaggatgcagtgaattgtacctataagaatgaggatgactgtgtcgtcagattccagtactatgaagactctagtggaaagtccatcctgtatgtggtagaagagccagagtgtcccaagggccctgacatcctggtggtcctgctgtcagtgatgggggccattctgctcatcggccttgccactctgctcatctggaagctcctcatcaccatccacgaccgaaaagagtttgctaaatttgaggaagaacgcgccagagcaaaatgggacacagccaacaacccactgtataaagaggccacgtctaccttcaccaatatcacctaccggggcacttaatgataagcagtcatcctcagatcattatcagcctgtgccacgattgcaggagtctccgccatcatgtttacagaggacagtatttgtggggagggatttggggctcagagtggggtgggttgggagaatgtcagtatgtggaaatgtgggtctgtgtgtgtgtgtgtgtgtgtctgtgtgtgtgtgtgtgttgtgtgtgggagtgtgtaatttaaaattgtgatgtgtcctgataagccgagctccttagcctttgtccctagaatgcctcctgcaggggattcttcctgcttagcttgagggtgactatggagctaagcaggtgttcttcattacctcagtgagaagccagcttttctcatcaggccattgtccctgaagagaagggcagggctgagacctctcattccagaggaagggatgccaaaccttggctctaccctgagttcataagtttatggttcttgggcctgactctcagcagctatagtaggaactgctgtgcttggcagcccaggtcatctgtacctctgcctcctttcccctccctcaggctgaaggaggagtcagggagagctgaactatcagagctgcctgtgccttttgccatcccctcaacccagctatgtttctctcacaagggaagtccttgcaacctaattctttgacctgttgggagtgaggatgtccgggccactcagggtcattcatggcctgggggatgtaccagcatctcctagttcataatcacaacccttcagatttgccttattggcagctctactctggaggtttgtttagaagaagtgtgtcacccttaggccagcaccatctccttacctcctaattccacaccctcactgctgtagacatttgctatgagctggggatgtctctcatgaccaaatgcttttcctcaaagggagagagtgctattgtagagccagaggtctggcacccttccggccttctgtccctcgttcatagcacctccacatacccagccctgtgccttggtgtgctgtatccacccatggggctgattgtatttacctactacctcttggctgccttgtgaaggaattattcccatgagttggctgggaataagtgccaggatggaatgatgggtcagttgtaccagcatgtgtggcctgttcttctatgggttggacaacctcattttaactcagtctttaatctgagaggccacagtgcaattttattttatttttctcatgatgaggttttcttaacctaaaggaatatgtatataaacatgcttgcgttatgtttctaaatttatatgatggcaaagaaggagagcataggaagccacacagacttgggcagggtacagacactcccacttggcatcattcacagcaagtcactgtccagtggctgtatctgtgaggggctctctcatgatagaaggctatagggatagatgtatggacacattggacccttcctgaggaggagggactgttcttttgtctcagaaaagcagtggctccattggtgttgatatacatccaacattaaaagccacccccaatcgcccaagagaaaaagaaagccttatcaacagttgttccatgagcagaaaacaggagttctgatctcagtgttgcagctaaataatctttaactctaattaaggcaagtcactttcttcttcttaaggctgttttctagtttgagaaatgggttttgagcagccagtcttgaaggtctctttcagtatcaacattctaagatgctgggacttactgtggcatcaaatgtgtggtcaagattctgtgggatattgatactgtgtgtgttttcagttgggagatctgagagacctggctttggcaagagcagatgtcattccatatcacctttctcaatgaaagtctcattctatcctctctccaaaccccttttccaacatttgttaatagttatgtctctcctgatgtagcacttaagcttcatttagctattatttctttcttcactttgcacacatttgcatccacatattagggaagaggaatccataagcagctgaaatatctattctgtattcttgtgttaacattgagaataagc

SEQ ID NO: 86 - protein, 788 aa, Macaca mulatta
MRAQPGPRPLWATVLALGALAGVGVAGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLSLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSRHCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 87 - DNA, 2636 bp, Pan troglodytes
  CDS (30)..(2396)
cgggcggagcgccgcgggaggcggacgagatgcgagcgcggccgcggccccggccgctctgggcgactgtgctggcgctgggggcgctggcgggcgttggcgtcggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccagctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcaaaaacccctgctatgatatgaagaccacctgcttgcccatgtttggctataaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcccaatgacgggcagtgtcatgttggtagtgacaatcattactctgcctccactaccatggattatccctctttggggctgatgactgagaagctatcccagaaaaacatcaatttgatatttgcagtgactgaaaatgtagtcaatctctatcagaactatagtgagctcatcccagggaccacagttggggttctgtccatggattccagcaatgtcctccagctcattgttgatgcttatgggaaaatccgctctaaagtcgagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgagtgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaagctcctcatcaccatccacgaccgaaaagagttcgctaaatttgaggaagaacgcgccagagcaaaatgggacacagccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttgggactcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataa

SEQ ID NO: 88 - protein, 788 aa, Pan troglodytes
MRARPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALQLRPDDSKNFSIQVRQVEDYPVDIYYLMDLSYSMKDDLWSIQNLGTKLATQMRKLTSNLRIGFGAFVDKPVSPYMYISPPEALKNPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 89 - DNA, 2535 bp, Pan paniscus
  CDS (70)..(2295)
gttgcagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcccaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgctctaaagtcgagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcctgtgggcttcaaggacagcctgatcgtccaggtcacctttgattgtgactgtgcctgccaggcccaagctgaacctaatagccatcgctgcaacaatggcaatgggacctttgagtgtgggatatgccgttgtgggcctggctggctgggatcccagtgtgagtgctcagaggaggactatcgcccttcccagcaggacgagtgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaagctcctcatcaccatccacgaccgaaaagagttcgctaaatttgaggaagaacgcgccagagcaaaatgggacacagccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttggggctcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataa

SEQ ID NO: 90 - protein, 741 aa, Pan paniscus
MCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGICRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 91 - DNA, 2613 bp, Pongo abelii
  CDS (30)..(2396)
cgggcggagcgccgcgggaggcggacgagatgcgagcgcggccgcggccccggccgctctgggcgactgtgctggcgctgggggcgctggcgggcgttggcgtcggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccctggaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgctatcatgcaggctacagtctgtgatgaaaagattggctggaggaatgacgcatcccacttgctggtgtttaccactgatgccaagactcatatagcactggacggaaggctggcaggcattgtccagcccaatgatgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagtcggggttctgtccatggattccagcaatgtcctccagctcattgtcgatgcttatgggaaaatccgctctaaagtcgagctggaagtgcgtgacctccctgaagagttgtctctatccttcaatgccacctgcctcaacaatgaggtcatccctggcctcaagtcttgtatgggactcaagattggagacacggtgagcttcagcattgaggccaaagtgcgaggctgtccccaggagaaggagaagtcctttaccatcaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgagtgcagcccccgggagggtcagcccgtctgcagccagcggggcgagtgcctctgtggtcagtgtgtctgccacagcagtgactttggcaagatcacgggcaagtactgcgagtgtgatgacttctcctgtgtccggtacaagggggagatgtgctcaggccatggccagtgcagctgtggggactgcctgtgtgactctgactggaccggctactactgcaactgtaccacacgtactgacacctgcatgtccagcaatgggctgctgtgcagcggccgcggcaagtgtgaatgtggcagctgtgtctgtatccagccaggctcctatggggacacctgtgagaagtgccccacctgcccagatgcctgcacctttaagaaagaatgtgtggagtgtaagaagtttgatcggggagccctacatgacgaaaatacctgcaaccgttactgccgtgatgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcatcggccttgccgctctgctcatctggaagctcctcatcaccatccacgaccgaaaagagttcgctaaatttgaggaagaacgcgccagagcaaaatgggacacagccaacaacccactgtataaagaggccacatctaccttcaccaatatcacgtaccggggcacttaatgataagcagtcatcctcagatcattatcagcctgtgccacgattgcaggaatctctgccatcatgtttacagaggacagtatttgtggggagggatttgtgggatgggttgggagaatgtcagtatgtggaagtgtgggtctgtgtgtgtgtgtgtgggtctgtgtgtgtatgtgtgtgggagtgtgtaatttaaaattgtgatgtgtcctgataa

SEQ ID NO: 92 - protein, 788 aa, Pongo abelii
MRARPRPRPLWATVLALGALAGVGVGGPNICTTRGVSSCQQCLAVSPMCAWCSDEALPLGSPRCDLKENLLKDNCALESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 93 - DNA, 2613 bp, Pongo abelii
  CDS (30)..(2396)
cgggcggagcgccgcgggaggcggacgagatgcgagcgcggccgcggccccggccgctctgggcgactgtgctggcgctgggggcgctggcgggcgttggcgtcggagggcccaacatctgtaccacgcgaggtgtgagctcctgccatcagtgcctggctgtgagccccatgtgtgcctggtgctctgatgaggccctgcctctgggctcacctcgctgtgacctgaaggagaatctgctgaaggataactgtgccctggaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgctatcatgcaggctacagtctgtgatgaaaagattggctggaggaatgacgcatcccacttgctggtgtttaccactgatgccaagactcatatagcactggacggaaggctggcaggcattgtccagcccaatgatgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagtcggggttctgtccatggattccagcaatgtcctccagctcattgtcgatgcttatgggaaaatccgctctaaagtcgagctggaagtgcgtgacctccctgaagagttgtctctatccttcaatgccacctgcctcaacaatgaggtcatccctggcctcaagtcttgtatgggactcaagattggagacacggtgagcttcagcattgaggccaaagtgcgaggctgtccccaggagaaggagaagtcctttaccatcaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgagtgcagcccccgggagggtcagcccgtctgcagccagcggggcgagtgcctctgtggtcagtgtgtctgccacagcagtgactttggcaagatcacgggcaagtactgcgagtgtgatgacttctcctgtgtccggtacaagggggagatgtgctcaggccatggccagtgcagctgtggggactgcctgtgtgactctgactggaccggctactactgcaactgtaccacacgtactgacacctgcatgtccagcaatgggctgctgtgcagcggccgcggcaagtgtgaatgtggcagctgtgtctgtatccagccaggctcctatggggacacctgtgagaagtgccccacctgcccagatgcctgcacctttaagaaagaatgtgtggagtgtaagaagtttgatcggggagccctacatgacgaaaatacctgcaaccgttactgccgtgatgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcatcggccttgccgctctgctcatctggaagctcctcatcaccatccacgaccgaaaagagttcgctaaatttgaggaagaacgcgccagagcaaaatgggacacagccaacaacccactgtataaagaggccacatctaccttcaccaatatcacgtaccggggcacttaatgataagcagtcatcctcagatcattatcagcctgtgccacgattgcaggaatctctgccatcatgtttacagaggacagtatttgtggggagggatttgtgggatgggttgggagaatgtcagtatgtggaagtgtgggtctgtgtgtgtgtgtgtgggtctgtgtgtgtatgtgtgtgggagtgtgtaatttaaaattgtgatgtgtcctgataa

SEQ ID NO: 94 - protein, 788 aa, Pongo abelii
MRARPRPRPLWATVLALGALAGVGVGGPNICTTRGVSSCHQCLAVSPMCAWCSDEALPLGSPRCDLKENLLKDNCALESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 95 - DNA, 4279 bp, Orcinus orca
  CDS (24)..(2378)
gagcgcggcggccagcggacgagatgcgagcgctgccgctgtgggccgctgtgctggtgctgggagcgctggcgggcgtcggcgtcggagggcccaacatctgtgccacacgaggcgtgagctcctgccagcaatgtctggctgtgagtcccatgtgtgcctggtgctctgatgaggctctgcctccgggctcgccccgctgtaacctgaaggagaatctgctgaaggatgactgcgccctggagtccatcgagttccccatcagcgaggccagaatcctggaggccaggcccctcagtgacaagggctctggagacagctcccagatcactcaagtcagtccccagaggattgcactccggctacggccagatgattcgaagaatttctccgtccaagttcggcaggtggaggattaccctgtggacatctactacttaatggacctgtcttattccatgaaggatgatctgtggagcatccagaacctgggtaccaagctggcctcccagatgcgtaagctcaccagtaacctgcggattggcttcggggcctttgtggacaagcccgtttcaccatacatgtacatctccccaccagaggccctcagaaacccctgctatgatatgaagaccacctgtttgcccatgtttggctacaaacacgtgctgacgctaactgaccaggtgacccgtttcaatgaggaggtgaagaagcagagtgtgtcacgaaaccgagatgccccagagggtggctttgatgccatcatgcaggctaccgtctgtgatgagaagattggctggaggaatgatgcctcccacttgctggtgtttaccactgatgccaagacccatatagcgctggatggaaggctggcaggcatcgtccagcccaacgatgggcagtgtcacgtgggcagtgacaaccattatgctgcctccactaccatggattatccctctctggggctgatgaccgagaagctgtcccagaaaaacatcaatttgatctttgcagtgactgaaaatgtagtcaatctctaccagaactatagtgagctcatcccagggaccacagtgggggtcctgtctactgattccagcaatgtccttcagctcattgttgatgcttacgggaaaatccgctctaaagtagagctggaagtgcgtgacctccctgaggagttgtccttatccttcaacgccacctgtctcaacaacgaggtcatcccaggccttaagtcttgtgtcggactcaagattggagacacggtgagcttcagcattgaggccaaggtgcgtggctgcccccaggagaaggagaagtccttcaccatcaagcctgtgggcttcaaagacagcctcaccgtccaggtcaccttcgactgtgactgtgcctgccaggcccaggctgagcctcagagccaccactgcaacaacggcaacgggacctttgagtgtggggtgtgccgctgcgggcctggctggctggggtcccagtgtgagtgctcagaagaggactaccgtccctcccagcaggacgagtgtagcccccgggagggccagcccatctgcagccagcggggcgagtgtctctgtggccagtgcgtctgccatagcagtgactttggcaagatcacgggcaagtactgtgagtgtgatgacttctcctgtgtccgctacaagggggagatgtgctcaggccatggccagtgcagctgtggggactgcctgtgtgactccgactggaccggctactactgcaactgtacgacacgcacggacacctgcatgtccagcaatgggctgctgtgcagcgggcggggcaagtgtgaatgcggcagctgcgtctgcatccagccgggctcctacggggacacctgtgagaagtgtcccacctgccctgatgcctgcacctttaagaaggagtgtgtggagtgtaagaagtttaaccgaggagccctatacgaggagaatacctgcagccgctactgccgtgatgagatcgagcctgtgaaggagcttaaggacactggaaaggatgctgtgaattgtacctacaagaatgaggaggactgtgtcgtcagattccagtactatgaagactccagtggaaagtccatcctgtatgtggtagaagagcccgagtgtcccaagggccctgacatcctggtggtcctgctttcagtgatgggggccattctgctcatcggccttgctactctgctcatctggaagctcctcattaccatccatgaccggaaggagtttgctaaatttgaggaggagagagccagagccaaatgggacacagccaacaacccactgtataaagaggccacgtccaccttcaccaacatcacctatcggggcacttaatgacaggcagtcatcctcagatcactatcagactgtcccaggattgtgggtgtctctgctgtcgtgtttacaggggcaatacctgtggggcagaattgggggcttggagtggggtgggttggaagaatgtgggtctctgtgcgtgtgtgcatgtgagtgtgctgcgtgtgggagagtgtgtaacttaaaacttgtgatgtgtcccagataagcagagctcctcgcctttgtcctcagaacgcctccttcagggagtctacctgcttaacctgagggtgacctagtagctgagcaggtattcttcattacctcagtgggaagccagctttccttctcaggccattctcttaaagaggagggcagggccaaggcctctcatttcagagaaagggaccttggtttaccctgtgtttgtggttcttgggcctgactctcagcagctctggtaggaactgccaggctttgcagccttgctgtgtcatccatgcccctagctcctctcccttccctcaggcagaaggagaaatccggggagagctgaaccatcagagctgcctgtctttgccatcacctcaatccagcatggttctctcctaaaggaagtccttgctacctattcttcggtctgttgagagtgagaacggcagggtcacccacgggtcatgcatggcctggggttaaggtgcccgagttccccagttcataatcctaacccttcagatttgcctcattgacagctctaccctagtgattcgtgtagaaaaagtgtgtcacccttagaccagcaacacctctttacctcctattccaccctttcactactatagacatttgctacatacggggaatttctctcatgaccagaagcttttccttccagggagagtgccatggttagagccagaggtctggcctcacccttcaggccttctgtctcgtgtccaaggcacctccacacacccaaccctgtgcttctgtgtgctacgtccacccatggggctgattgcatttatctacctcttgggtgtcttgtgaaggcgtcattcccacgggtctttgagtctgctgggcataagtgccagggtggaatgacgggccagtcgtatcagcgtgtgtggcccatcctcctgtgggccgggcaacctcatttaactcagtctttaatctgagaggccacaagtgcaattttgttttatttttctcattggggcacctgaaaccatgatgaggcttgtttaatctaaaggagcatagatataaacacacttgcattatatttgtaattttatttgatgatgaagaaaagggtgaaaagccacacagacctgggctggatgcagacactcccacttagcgtcattcatagcaagttgctgcccagttgctgggtctgtaagggctctctcatccctgaagcctgcggggatggacacgtggacatgctggaccttgcccaagcaggaggaggtaaatgggctgttctttttttctagcaaaagcagaaaaactccattggtgtttacattcgttcaacgttaaccaccaccaccactccccaagaaaaagggaggggcctaaaaacagtggtctgatggtcagaaaatctaagtcctggcctcagtgttgcagctaaggaactttaaccttaattaaggcaagttactttctttttcctggggctcagttttctagtttgaaaaatgatgggtttggaccagccagtctaggcagtctctttcagtgtcaacagtctgtgatgctgggacttactgtggcatcaaacatgcagtcaggattctgtgggatgttgatactgtttgttttttcagttgggagacctggctctggcaagagcagatgtcatcccatatcacctttctcaatgaaaaagcttcattctg

SEQ ID NO: 96 - protein, 784 aa, Orcinus orca
MRALPLWAAVLVLGALAGVGVGGPNICATRGVSSCQQCLAVSPMCAWCSDEALPPGSPRCNLKENLLKDDCALESIEFPISEARILEARPLSDKGSGDSSQITQVSPQRIALRLRPDDSKNFSVQVRQVEDYPVDIYYLMDLSYSMKDDLWSIQNLGTKLASQMRKLTSNLRIGFGAFVDKPVSPYMYISPPEALRNPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYAASTTMDYPSLGLMTEKLSQKNINLIFAVTENVVNLYQNYSELIPGTTVGVLSTDSSNVLQLIVDAYGKIRSKVELEVRDLPEELSLSFNATCLNNEVIPGLKSCVGLKIGDTVSFSIEAKVRGCPQEKEKSFTIKPVGFKDSLTVQVTFDCDCACQAQAEPQSHHCNNGNGTFECGVCRCGPGWLGSQCECSEEDYRPSQQDECSPREGQPICSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFNRGALYEENTCSRYCRDEIEPVKELKDTGKDAVNCTYKNEEDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 97 - DNA, 3033 bp, Orcinus orca
  CDS (70)..(2295)
gttacagggcccaacatctgtgccacacgaggcgtgagctcctgccagcaatgtctggctgtgagtcccatgtgtgcctggtgctctgatgaggctctgcctccgggctcgccccgctgtaacctgaaggagaatctgctgaaggatgactgcgccctggagtccatcgagttccccatcagcgaggccagaatcctggaggccaggcccctcagtgacaagggctctggagacagctcccagatcactcaagtcagtccccagaggattgcactccggctacggccagatgattcgaagaatttctccgtccaagttcggcaggtggaggattaccctgtggacatctactacttaatggacctgtcttattccatgaaggatgatctgtggagcatccagaacctgggtaccaagctggcctcccagatgcgtaagctcaccagtaacctgcggattggcttcggggcctttgtggacaagcccgtttcaccatacatgtacatctccccaccagaggccctcagaaacccctgctatgatatgaagaccacctgtttgcccatgtttggctacaaacacgtgctgacgctaactgaccaggtgacccgtttcaatgaggaggtgaagaagcagagtgtgtcacgaaaccgagatgccccagagggtggctttgatgccatcatgcaggctaccgtctgtgatgagaagattggctggaggaatgatgcctcccacttgctggtgtttaccactgatgccaagacccatatagcgctggatggaaggctggcaggcatcgtccagcccaacgatgggcagtgtcacgtgggcagtgacaaccattatgctgcctccactaccatggattatccctctctggggctgatgaccgagaagctgtcccagaaaaacatcaatttgatctttgcagtgactgaaaatgtagtcaatctctaccagaactatagtgagctcatcccagggaccacagtgggggtcctgtctactgattccagcaatgtccttcagctcattgttgatgcttacgggaaaatccgctctaaagtagagctggaagtgcgtgacctccctgaggagttgtccttatccttcaacgccacctgtctcaacaacgaggtcatcccaggccttaagtcttgtgtcggactcaagattggagacacggtgagcttcagcattgaggccaaggtgcgtggctgcccccaggagaaggagaagtccttcaccatcaagcctgtgggcttcaaagacagcctcaccgtccaggtcaccttcgactgtgactgtgcctgccaggcccaggctgagcctcagagccaccactgcaacaacggcaacgggacctttgagtgtggggtgtgccgctgcgggcctggctggctggggtcccagtgtgagtgctcagaagaggactaccgtccctcccagcaggacgagtgtagcccccgggagggccagcccatctgcagccagcggggcgagtgtctctgtggccagtgcgtctgccatagcagtgactttggcaagatcacgggcaagtactgtgagtgtgatgacttctcctgtgtccgctacaagggggagatgtgctcaggccatggccagtgcagctgtggggactgcctgtgtgactccgactggaccggctactactgcaactgtacgacacgcacggacacctgcatgtccagcaatgggctgctgtgcagcgggcggggcaagtgtgaatgcggcagctgcgtctgcatccagccgggctcctacggggacacctgtgagaagtgtcccacctgccctgatgcctgcacctttaagaaggagtgtgtggagtgtaagaagtttaaccgaggagccctatacgaggagaatacctgcagccgctactgccgtgatgagatcgagcctgtgaaggagcttaaggacactggaaaggatgctgtgaattgtacctacaagaatgaggaggactgtgtcgtcagattccagtactatgaagactccagtggaaagtccatcctgtatgtggtagaagagcccgagtgtcccaagggccctgacatcctggtggtcctgctttcagtgatgggggccattctgctcatcggccttgctactctgctcatctggaagctcctcattaccatccatgaccggaaggagtttgctaaatttgaggaggagagagccagagccaaatgggacacagccaacaacccactgtataaagaggccacgtccaccttcaccaacatcacctatcggggcacttaatgacaggcagtcatcctcagatcactatcagactgtcccaggattgtgggtgtctctgctgtcgtgtttacaggggcaatacctgtggggcagaattgggggcttggagtggggtgggttggaagaatgtgggtctctgtgcgtgtgtgcatgtgagtgtgctgcgtgtgggagagtgtgtaacttaaaacttgtgatgtgtcccagataagcagagctcctcgcctttgtcctcagaacgcctccttcagggagtctacctgcttaacctgagggtgacctagtagctgagcaggtattcttcattacctcagtgggaagccagctttccttctcaggccattctcttaaagaggagggcagggccaaggcctctcatttcagagaaagggaccttggtttaccctgtgtttgtggttcttgggcctgactctcagcagctctggtaggaactgccaggctttgcagccttgctgtgtcatccatgcccctagctcctctcccttccctcaggcagaaggagaaatccggggagagctgaaccatcagagctgcctgtctttgccatcacctcaatccagcatggttctctcctaaaggaagtccttgctacctattcttcggtctgttgagagtgagaacggcagggtcacccacgggtcatgcatggcctggggttaaggtgcccgagttccccagttcataatcctaacccttcagatttgcctcattgacagc

SEQ ID NO: 98 - protein, 741 aa, Orcinus orca
MCAWCSDEALPPGSPRCNLKENLLKDDCALESIEFPISEARILEARPLSDKGSGDSSQITQVSPQRIALRLRPDDSKNFSVQVRQVEDYPVDIYYLMDLSYSMKDDLWSIQNLGTKLASQMRKLTSNLRIGFGAFVDKPVSPYMYISPPEALRNPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYAASTTMDYPSLGLMTEKLSQKNINLIFAVTENVVNLYQNYSELIPGTTVGVLSTDSSNVLQLIVDAYGKIRSKVELEVRDLPEELSLSFNATCLNNEVIPGLKSCVGLKIGDTVSFSIEAKVRGCPQEKEKSFTIKPVGFKDSLTVQVTFDCDCACQAQAEPQSHHCNNGNGTFECGVCRCGPGWLGSQCECSEEDYRPSQQDECSPREGQPICSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFNRGALYEENTCSRYCRDEIEPVKELKDTGKDAVNCTYKNEEDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 99 - DNA, 2374 bp, Canis lupus familiaris
  CDS (1)..(2355)
atgcgggcgcggccgctctgggccgcggtgctgctgctgggggcgctggcgggcaccggcgtcggagtgtccaacatctgtaccacacgaggtgtccactcctgccagcaatgtctagctgtgagtcctgtgtgtgcctggtgctcagatgaggccctgcctctgggctctccccgctgtaacctgaaggaaaatctgctgaaggataactgtgccctggaatccattgagttccccatcagtgaggtccgcatcctggaggccaggccccttagcaacaagggctctggagacagctcccagattactcaagtcagccctcagaggattgcgctgcggctccggccagatgattcaaagaatttctccatccaagttcggcaagtagaggattaccctgtggacatctactacttgatggacctgtcttattccatgaaggatgatctgtcgagcatccagaacctaggcaccaggctggcctcccagatgcacaagctcaccagtaacttgcggattggcttcggggcttttgtggacaagcctgtgtctccatacatgtacatctccccaccagaggccctcaaaaacccctgctatgatatgaagaccacctgtttgcctatgtttggctacaaacatgtgctgacgctaactgaccaggtgacccgcttcaatgaggaagtgaaaaagcagagtgtgtcacggaaccgagatgccccagagggcggctttgatgctatcatgcaggctacagtctgtgatgagaagattggctggaggaatgatgcatcccacttgctggtatttaccactgatgccaagacccatatagcgctggatggaaggctggcaggcattgtccaacctaacgatgggcagtgtcacattggcagtgacaaccattattctgcctccactaccatggattatccctctctgggactgatgacagagaagctctcccagaaaaacatcaatttgatctttgcagtaacggaaaatgtggtcaatctctaccagaactacagtgagctcatcccagggaccacagtggggattctgtctacggattccagcaatgtccttcagctcattgttgatgcttatggaaaaatccgctctaaagtggagctggaagtgcgtgacctccctgaggagttgtctctatcgttcaacgccacctgtctcaacaatgaggtcatcccgggcctcaagtcttgtgtcggcctcaagattggagacacggtgagcttcagcattgaggccaaagtgcgaggctgcccccaggagaaggagaagtccttcaccatcaagcctgtgggcttcaaagacagcctcaccatccaggtcacctttgactgtgactgtgcctgccaggcccaggctgagccttccagtcaccgctgcaacaatggcaatgggacctttgagtgtggggtgtgcctctgtgggcctggctggctggggtcccagtgtgaatgctcggaagaggactatcatccctcccagcaggacgagtgcagcccccgggagggccagcccgcctgcagccagcggggcgagtgcctgtgtggccaatgtgtctgccatagcagtgactttggcaagatcacgggcaagtactgcgagtgtgatgacttctcctgtgtccgctacaagggggagatgtgctcaggccatggccagtgcagctgtggggactgcctgtgtgactccgactggaccggctactactgcaactgtaccacgcgcactgacacgtgcatgtccagcaacgggctgctgtgcggcggtcggggcaagtgtgagtgtggcagctgcgtgtgcatccaacctggctcctacggggacacctgcgagaagtgccccacctgccctgacgcctgcacctttaagaaggagtgtgtggagtgtaagaaatttgaccgaggaactctccatgatgataatacctgcaaccgttactgtcgtgatgagattgagtctgtgaaggagcttaaggatactggcaaggatgcagtgaattgtacatacaagaatgaggatgactgtgttgtcagatttcagtactatgaagactccagtggaaagtccattctctatgtggtagaagagccagagtgtcccaagggtcctgacatcctggtggtcctgctttcagtgatgggggccattttgctcattggccttgctactctgctcatctggaagctcctcatcaccatccatgatcggaaggagtttgctaaatttgaggaagagcgagccagagcaaaatgggacacagccaacaacccactgtataaagaggccacatccacttttaccaacatcacctaccggggcacttaacaccaaggagccatcctca

SEQ ID NO: 100 - protein, 784 aa, Canis lupus familiaris
MRARPLWAAVLLLGALAGTGVGVSNICTTRGVHSCQQCLAVSPVCAWCSDEALPLGSPRCNLKENLLKDNCALESIEFPISEVRILEARPLSNKGSGDSSQITQVSPQRIALRLRPDDSKNFSIQVRQVEDYPVDIYYLMDLSYSMKDDLSSIQNLGTRLASQMHKLTSNLRIGFGAFVDKPVSPYMYISPPEALKNPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHIGSDNHYSASTTMDYPSLGLMTEKLSQKNINLIFAVTENVVNLYQNYSELIPGTTVGILSTDSSNVLQLIVDAYGKIRSKVELEVRDLPEELSLSFNATCLNNEVIPGLKSCVGLKIGDTVSFSIEAKVRGCPQEKEKSFTIKPVGFKDSLTIQVTFDCDCACQAQAEPSSHRCNNGNGTFECGVCLCGPGWLGSQCECSEEDYHPSQQDECSPREGQPACSQRGECLCGQCVCHSSDFGKITGKYCECDDFSCVRYKGEMCSGHGQCSCGDCLCDSDWTGYYCNCTTRTDTCMSSNGLLCGGRGKCECGSCVCIQPGSYGDTCEKCPTCPDACTFKKECVECKKFDRGTLHDDNTCNRYCRDEIESVKELKDTGKDAVNCTYKNEDDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 101 - DNA, 5284 bp, Canis lupus familiaris
  CDS (28)..(2370)
ggagaagtagcagaactagagtgctggatgccaaggaggtcaccaacagggcactgctgggctgagcctcaaacagagcttgtgtccaacatctgtaccacacgaggtgtccactcctgccagcaatgtctagctgtgagtcctgtgtgtgcctggtgctcagatgaggccctgcctctgggctctccccgctgtaacctgaaggaaaatctgctgaaggataactgtgccctggaatccattgagttccccatcagtgaggtccgcatcctggaggccaggccccttagcaacaagggctctggagacagctcccagattactcaagtcagccctcagaggattgcgctgcggctccggccagatgattcaaagaatttctccatccaagttcggcaagtagaggattaccctgtggacatctactacttgatggacctgtcttattccatgaaggatgatctgtcgagcatccagaacctaggcaccaagctggcctcccagatgcacaagctcaccagtaacttgcggattggcttcggggcttttgtggacaagcctgtgtctccatacatgtacatctccccaccagaggccctcaaaaacccctgctatgatatgaagaccacctgtttgcctatgtttggctacaaacatgtgctgacgctaactgaccaggtgacccgcttcaatgaggaagtgaaaaagcagagtgtgtcacggaaccgagatgccccagagggcggctttgatgctatcatgcaggctacagtctgtgatgagaagattggctggaggaatgatgcatcccacttgctggtatttaccactgatgccaagacccatatagcgctggatggaaggctggcaggcattgtccaacctaacgatgggcagtgtcacattggcagtgacaaccattattctgcctccactaccatggattatccctctctgggactgatgacagagaagctctcccagaaaaacatcaatttgatctttgcagtaacggaaaatgtggtcaatctctaccagaactacagtgagctcatcccagggaccacagtggggattctgtctacggattccagcaatgtccttcagctcattgttgatgcttatggaaaaatccgctctaaagtggagctggaagtgcgtgacctccctgaggagttgtctctatcgttcaacgccacctgtctcaacaatgaggtcatcccgggcctcaagtcttgtgtcggcctcaagattggagacacggtgagcttcagcattgaggccaaagtgcgaggctgcccccaggagaaggagaagtccttcaccatcaagcctgtgggcttcaaagacagcctcaccatccaggtcacctttgactgtgactgtgcctgccaggcccaggctgagccttccagtcaccgctgcaacaatggcaatgggacctttgagtgtggggtgtgcctctgtgggcctggctggctggggtcccagtgtgaatgctcggaagaggactatcatccctcccagcaggacgagtgcagcccccgggagggccagcccgcctgcagccagcggggcgagtgcctgtgtggccaatgtgtctgccatagcagtgactttggcaagatcacgggcaagtactgcgagtgtgatgacttctcctgtgtccgctacaagggggagatgtgctcaggccatggccagtgcagctgtggggactgcctgtgtgactccgactggaccggctactactgcaactgtaccacgcgcactgacacgtgcatgtccagcaacgggctgctgtgcggcggtcggggcaagtgtgagtgtggcagctgcgtgtgcatccaacctggctcctacggggacacctgcgagaagtgccccacctgccctgacgcctgcacctttaagaaggagtgtgtggagtgtaagaaatttgaccgaggaactctccatgatgataatacctgcaaccgttactgtcgtgatgagattgagtctgtgaaggagcttaaggatactggcaaggatgcagtgaattgtacatacaagaatgaggatgactgtgttgtcagatttcagtactatgaagactccagtggaaagtccattctctatgtggtagaagagccagagtgtcccaagggtcctgacatcctggtggtcctgctttcagtgatgggggccattttgctcattggccttgctactctgctcatctggaagctcctcatcaccatccatgatcggaaggagtttgctaaatttgaggaagagcgagccagagcaaaatgggacacagccaacaacccactgtataaagaggccacatccacttttaccaacatcacctaccggggcacttaacaccaaggagccatcctcagatcactatcagtctgtcccagaattgtggacatctctgctgtcatgtttacagggaacagtatctgtggggcgggattgggggctggttgtggggtgggttggaggaatggcagcatgcggaggtgtggctctgtgtgtgtgtgtgtgtgtctgtgtgagtgtgttgcgtgtgggggaatgtgtaatttaaagtttgtggtgtgtcccaggtcagcggaactcctcagcctttatccacagaatgcctccttcagggatctttcctgcttaacctgagggtgacatagctgagcaggtgttcattacctcagtgagaagccagctctcctttccaggccattttttctgaagagaagggcagggctgagtctctcattccagaggaagcggccttgattctactttgagtttatggttctcaggcctgactctcagtggctctgatagcaactgctgggcttggcagtcttgtgtcagctaggcctttatctcctttcccttccctcaggctgaaggagaaatcagaggcaagctgaaccatcagagttgcctgtgccttttgccatcacctcaatccagtatggttccctcataaagggagtccttgctagcaattgtgttgggagtgaggatggtagggctactcaggggtcgtgcatggcctggatgaatgtgccagggtccccagttcataatcataacccttaagatttgtctcattggcagctccaccctagaagttcgtttagaagtgcgtcacccttagaccagcatcacttctttaccttccacttccacactctcactgctgtaaacatactgggaatttctttcatgaccaaatgcttttcctcccagggtgagtgctacgattagagcccgaggtctggccccactcttcaggccctccccgccttgtccaaggcacctccacacacccaacctggtgctaacgtgtggtacattcatccatgcggctgattacatttatctacctcttggctgtcttgtgaatgaatagttcccatgggtctctgagtctgatgggaataagtgccacatttggaatgatggaccagttgtatcagcatgtgtggcctattctcctatgggctgggcaacctcattttaactcagtctttaatttgggaggctgtgactgcaattttattttattttttcattgggtcacctgaaaccatgatgaggcttgtttaatctaaaggaatatgtatataaacacactcgcatatacttgtaattttatttgatggtgaggagggagaatattaaaaaaaaaacaaaacctacacagacttggactggatacaaaccctcccacttggcatcattcatagcaagttgctgctcagttgctaggtctgtaagggctctctcattctggaagcctttggggatggacccatgggcatgttgggctctttctaaggagatggaatacaggctgttcttttttcctagccataacagttgctccgttggtgtttaccttagtctaacattaacaactatcttcactgccattcatcaagaaaaagggaaggacctatacacagtggtctgatgatcagagaaatctaagccctagcctcagtgttgcagctaaggaatttttaacttcgattaaggcaagtctccctggggctcaattttctagtttgaaaaatggtaggcttggaccagccactctagaaggtctcttacagtattgatattctaagatgctgggacttcctgagacatcaaacgtacagtcaagattctgtgagatgttgttactatttgttgttatagttgggagatctgagagacctggctttgacaagcgcagatatcattccatatcacctttcccaatgaaagagcctcattctatcctctcttagaaccccttccccaacatttttttttattttcattgatgtttttttaataataaatttattttttattggtgttcaatttgccaacatacagaaaaacacccagtgcccttcctcaacatttgttagcagttacatctcctgatgtagcactcaagctccacttagtttattatttcctagttcactttgcacacatttgcatccatgcatatggaagaggcatccgtaagaagtagctgaaatatatattctgtattcatgtgttaacattgagaataagccttggaattagaaatggggcaaatgactgagccttgtctcacccatggattaccctttagtgaaggggatggaagtgcagtagagggatggtagtacagtagagggttgggtccaagaaatttcaaacctaactatatcctttggctactgagacaagagtctattagagtagtagttggacattttatttagataagatggtttatatgaagaaactatatcaaaagaggaagaacatatatttataagattaaaataatcagtaggactcttgtctgagcttctggaacgaggcttctaggttttaaaagaccaatactctttgtctgtatatggggagaacctgttcacgagatagcaaagaaaagtcagttttggcatcacatggggtgaacatctaaatagtattttggcatcagcacagccccaaaaggttattattcatgctcagctcctctggaaataatttatgttcaatctcagggtctgtggacagtaatgggaagctctgaacgttccttacaagttgtcccataaggagtcagttctttacctctcagatattcttagaccatccatgacttcaagatacttttctttgttaagtattcctggttgaaatgacttaagtgccttcctgacttcccagccacccctctgtttgagttgtgcaacagtgaattaaatgtgttttccaaaacgaa

SEQ ID NO: 102 - protein, 780 aa, Canis lupus familiaris
MPRRSPTGHCWAEPQTELVSNICTTRGVHSCQQCLAVSPVCAWCSDEALPLGSPRCNLKENLLKDNCALESIEFPISEVRILEARPLSNKGSGDSSQITQVSPQRIALRLRPDDSKNFSIQVRQVEDYPVDIYYLMDLSYSMKDDLSSIQNLGTKLASQMHKLTSNLRIGFGAFVDKPVSPYMYISPPEALKNPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHIGSDNHYSASTTMDYPSLGLMTEKLSQKNINLIFAVTENVVNLYQNYSELIPGTTVGILSTDSSNVLQLIVDAYGKIRSKVELEVRDLPEELSLSFNATCLNNEVIPGLKSCVGLKIGDTVSFSIEAKVRGCPQEKEKSFTIKPVGFKDSLTIQVTFDCDCACQAQAEPSSHRCNNGNGTFECGVCLCGPGWLGSQCECSEEDYHPSQQDECSPREGQPACSQRGECLCGQCVCHSSDFGKITGKYCECDDFSCVRYKGEMCSGHGQCSCGDCLCDSDWTGYYCNCTTRTDTCMSSNGLLCGGRGKCECGSCVCIQPGSYGDTCEKCPTCPDACTFKKECVECKKFDRGTLHDDNTCNRYCRDEIESVKELKDTGKDAVNCTYKNEDDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 103 - DNA, 2739 bp, Equus caballus
  CDS (1)..(2355)
atgcgagcgcggctgctctgggccgcggtgctggtgctgggggcgctggcgggcgtcggcgtcggagggcccaacatctgcaccacacgaggtgtgagctcctgccggcagtgcctggctgcgagtcccatgtgtgcctggtgctcggatgcggccctgcctctgggctcaccccgctgtaacctgaaggagaatctgctgaaggataactgtgcgctggggtccatcgagttccctgtcagtgaggccatcatcctggaggccaggcccctcagcgacaagggctctggagacagctcccagattactcaagtcagcccccagaggattgcactccggctacggccagatgattcgaagaatttctccgtgcaagtccggcaggtggaggattaccccgtggacatctactacttgatggacctgtcttactccatgaaggatgatctggggagcatccagaacctgggtaccaagctggcctcccagatgcggaaactcaccagtaacctgcggattggctttggggcttttgtggacaagcctgtgtcaccatacatgtttatctccccaccagaggcccttaaaaacccctgttatgatatgaagaacgtgtgtttgcccatgtttggctacaaacatgtgctgacactaacagaccaggtgacccgcttcaatgaggaggtgaagaagcagagcgtgtcacggaaccgagatgccccagagggtggctttgatgcaatcatgcaggctacagtctgtgataagaagattggctggaggaatgatgcatcccacttgctggtgtttaccactgatgccaagacccatatagcactggatggaagactggcaggcattgtccagcccaatgatgggcagtgtcacattggcagtgacaaccattactctgcctctactaccatggattatccctctctggggctgatgaccgagaagctatcccagaaaaacatcaatttgatctttgcagtgactgaaaatgtcgtcaatctctaccagaactacagtgagctcatccccgggaccacagtgggagttctgtctaccgattctagcaatgtcctccagctcattgttgatgcttatggaaaaatccgctctaaagtagagctggaagtacgtgacctccctgaggagttgtctctatccttcaacgccacctgtctcaacaacgaggtcatcccaggcctcaagtcttgtgttggactcaagattggagacacggtgagcttcagcattgaggctaaggtacgtggctgccctcaggagaaggagaagtccttcaccatcaagcctgtgggcttcaaagacagcctcactgtccaggtcacctttgactgcgactgtgcctgccaggcctgggctgagccttacagccaccgctgcaacaatggcaacgggacctttgagtgtggggtgtgccgctgtgggcctggctggctcgggtcccagtgcgagtgctcagaagaggactaccgcccctcccagcaggacgagtgcagccctcgggagggccagcccatctgcagccagcggggcgagtgcctctgtggccagtgcgtctgccacaccagtgactttggcaagatcacgggcaagtactgcgagtgtgatgacttctcctgtgtccgctacaagggggagatgtgctcaggccatggccagtgcagctgtggggactgcctgtgtgactccgactggactggctactactgcaactgtaccacgcgcaccgacacctgcatgtccagcaacgggctgctgtgcagcggccggggcaagtgtgaatgtggcagctgcgtctgcatccagccgggctcctacggggacacctgtgagaagtgtcccacctgccctgatgcctgcacctttaagaaggagtgtgtggagtgtaagaagtttgagcggggagccctctacgaggagaatacctgcacccgttactgtcgtgatgagatcgagtctgtgaaggagcttatggatactggcaaggatgcagtgaattgtacctacaagaatgaggatgactgtgttgtcagattccagtattatgaagacgccagtggaaagtccatcctgtatgtggtagaagagccagagtgtcccaagggccctgacatcctggtggtccttctttcagtgatgggggccattctgctcatcggtcttgctactctgctcatctggaagctcctcatcaccatccatgaccggaaggaatttgctaaatttgaggaagagcgagccagagcaaaatgggacactgccaacaacccactgtataaagaggccacatccaccttcaccaacatcacctaccgaggcacttaacgacaagcagttgtcctcagatcactatcagactgtcccaggattgtgggtgtctctgctgtcatgtttacaggggacaatgtctgtggggtgggactgggggcttggactggggtgggttggaagaatgtcagtatgtggaagtgtgggtctgtgcatgtgtgcgtgtgagtgtgctgtgagaggaggaatgtgtaattgaaaacttgtgatgtgtcacagataagcggagctcctcagctttgtcctcagaatgcctccttcagggattcttcctgcttaacctgagagtgacccatgtagctgagcaggtgttcttttttacctcagtgagaagccagcttttcttctcgggccgttctccctgaagagaagggcaggctg

SEQ ID NO: 104 - protein, 784 aa, Equus caballus
MRARLLWAAVLVLGALAGVGVGGPNICTTRGVSSCRQCLAASPMCAWCSDAALPLGSPRCNLKENLLKDNCALGSIEFPVSEAIILEARPLSDKGSGDSSQITQVSPQRIALRLRPDDSKNFSVQVRQVEDYPVDIYYLMDLSYSMKDDLGSIQNLGTKLASQMRKLTSNLRIGFGAFVDKPVSPYMFISPPEALKNPCYDMKNVCLPMFGYKHVLTLTDQVTRFNEEVKKQSVSRNRDAPEGGFDAIMQATVCDKKIGWRNDASHLLVFTTDAKTHIALDGRLAGIVQPNDGQCHIGSDNHYSASTTMDYPSLGLMTEKLSQKNINLIFAVTENVVNLYQNYSELIPGTTVGVLSTDSSNVLQLIVDAYGKIRSKVELEVRDLPEELSLSFNATCLNNEVIPGLKSCVGLKIGDTVSFSIEAKVRGCPQEKEKSFTIKPVGFKDSLTVQVTFDCDCACQAWAEPYSHRCNNGNGTFECGVCRCGPGWLGSQCECSEEDYRPSQQDECSPREGQPICSQRGECLCGQCVCHTSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFERGALYEENTCTRYCRDEIESVKELMDTGKDAVNCTYKNEDDCVVRFQYYEDASGKSILYVVEEPECPKGPDILVVLLSVMGAILLIGLATLLIWKLLITIHDRKEFAKFEEERARAKWDTANNPLYKEATSTFTNITYRGT

SEQ ID NO: 105 - DNA, 4990 bp, Felis catus
  CDS (78)..(2432)
ctcccgctgcgggaaaagtggccgcgggcgccgctactcgctgtggggcgggcgcggcggcggcggcggcggacgagatgcgagcgcggccgctctgggccgccgtgctggtgctgggggcgctggcgggcgtcggtgtcggagtgtccaacatctgtaccacacgaggcatccactcctgccaggagtgtctggctgtgagtcctgcgtgtgcctggtgctcagatgaggccctccctctgggctcgccccgctgtaacctgaaagagaatctgctgaaggataactgtgcgttggagtccgtcgagttccccgtcagtgaggcccgcatcttagaggccaggcccctcagcgacaagggctctggagacagctcccagattactcaagtcagcccccagaggattgcgctccggctccggccagatgattcgaagattttctccgtccgagtccggcaggtggaggattaccctgtggacatctactacttgatggacctgtcttactccatgaaggatgatctatggagcatccagaacctgggcaccaagctggcctcccagatgcgcaagctcaccagtaacttgcggattggctttggggcttttgtggacaagcctgtgtcaccatacatgtacatctcccctccagaggccctcaaaaacccctgctatgatatgaagaacacctgcttgcctatgtttggctacaaacatgtgctgacactaactgaccaggtgacccgcttcaatgaggaagtgaagaagcagagtgtgtcgcggaaccgagatgccccagagggtggctttgatgccatcatgcaggctacagtctgtgatgagaagattggctggaggaatgatgcctcccacttgctggtgtttaccactgatgccaagacccatattgcgctggatggaaggctggcaggcattgtccagcccaatgatgggcagtgccacgttggcagtgacaaccattactctgcctccactaccatggattatccctctctggggctgatgaccgagaagctatcccagaaaaacatcaatttgatctttgctgtaacggaaaatgtagtcagtctctaccagaactatagcgagctcatcccagggacgacagtgggggttctgtctgccaattccagcaacgtccttcagctcattgttgatgcttatgggaaaatccgctctaaagtagagctggaagtgcgggacctccccgaggagctgtctctatccttcaacgccacctgtctcaacaacgaggtcatccctggcctcaagtcttgtgtcggactcaagattggagacacggtgagcttcagcattgaggccaaggtgcgaggctgcccgcaggagagggagaagtccttcaccatcaagcctgtaggcttcaaagacagcctcaccgttcaggtcaccttcgactgtgactgtgcgtgccaggcccatgctgagccttacagccgccgctgcaacaatggcaacgggacctttgagtgtggggtgtgccgctgcgggcccgggtggctggggtcccagtgcgagtgctccgaagaggactaccgcccctcgcagcaggaagagtgcagcccccaggagggccagcccgcctgcagccagcggggcgagtgcctgtgtggccagtgcgtctgccacagcagtgactttggcaagatcacgggcaagtactgcgagtgtgatgacttctcctgcgtccgctataagggggagatgtgctcaggtcacggccagtgcagctgtggggactgtctgtgtgactccgactggaccggcttctactgcaactgcaccacgcgcaccgacacctgcatgtccagcaacgggctgctgtgcagcggccggggcaagtgtgagtgcggcagctgcgtgtgcatccagctcggctcctacggggacacctgtgagaagtgccccacctgccctgacacctgcacctttaagaaggagtgtgtggagtgtaagaaatttgaccggggagacctacgtaaagaaaatacctgcagccgttactgtcgtgatgagattgagtctgtgaaggagctcaaggatactggcaaggatgcagtgaactgcacgtacaagaatgaagatgactgtgttgtcagattccagtactatgaagactccagtggaaagtccattctctatgtggtagaggagccagagtgtcccaagggtcctgacatcctggtggtcctactctcagtgatgggggccattttgctcatcggccttgctactctgctcatctggaagctcctcatcaccatccatgaccggaaggagtttgctaaatttgaggaagagcgagccagagcaaaatgggacacagccaacaacccactgtataaagaggccacatccaccttcaccaacatcacctaccggggcacttaatgacaagcagtcatcctcagttcactgtcaggctgtcccagaattgtggacacatctgctgtcatgtttacagggaatgaaatctgtggggcaggatcgggggctgggagtggggtgggttccaagaatgtcagtatgtggaggtgtgggtctctgtgcgtgtgtacgcgtgagtgtgctgcatgtgggggagtgtgtaatttaaaacttgaggtgtgtccagacacgtggagctcctcagcctttgtccgcagaatgcctccttcagggatccttcctgcttaaccttagggtgacccacgtagctgagcaggtactgttcattacctcagtgagaagccagctttccttttccggccatttctcccaaagagaagggcagggctgagcctctcattccagaggaaggggccttgactctgccttgagtttacggttcttgggtccgacgctcagcagctctgatagcaaatgctgggctctgcagccttgttgtgtcatctggactttgatctcctttgccttccctcaggctgaaggagaaatcagaagcaagcggagccatcggagttgcctatgtcttttgctatcccctcaatccagtatggttctctcacaaggggagcccttgccagcaatcctgttgggagtgaggatgggaaggccactcaggggtcatgcatggcctggatgaatgtgccagagtcccccagttcataatcatcacccttcagatttgtctccttggcaccccaccctagaagttcgattggaggacgcgtgttacccttagaccagcatcacctctttaccttctacgtccacactctcactgctgtagacatttgctacatactgggaatttctttcatgaccggacgcttttcctcccagggagagtgctgtgatgagagccagagatctggccccacccttcaggccctctgccccttgtccaaggcacccccccgcccctacacccaatctggtgcttctgtgtgctacatccatccatggggctgattgcacttatctacctcttggctgtcttgtgaaggaatcattcccatgggtctctgagtctgctgggcatatgtgccacatttagaatgaggggccagttggatcagcgtgtgtggcctattctcctatgggctgggcaacctcattttaactcagtctttaatctgagaggccacaagtgcagttttattttatttttctcattgggtcacctgaaaccatgatgaggcttgcttaatctaaaggaatacgtacagaaacacctttgcattctattttgtagttttatttgaggaggaggagcatatttaaaaaaaaaaaaaaacaacaaccccacacagacttgggatggatacagaccctcccacttggcatcattcatagggagttgctgcccatttgctggatctgtaggggctctctcatcctgggagcctctggggacggccccacgggcatgctgggccatttctgagcaggaggggtacaagtggttcttttctcctagcagttgcttccttggtgttcacattggtctaaacattaacaaccaccctcaccccccattcatcaagaaaaaggaaagagctatagacagtggtctgacgatcagaaaatgtaagtcctggcctcattgttgcagctgaggaagctttacccttaattaaggccagcctctcttccttcccttcggggctcagttttctagtttgaaaaatgatagtttggaccagccagtctggaaggtgtctttcaatatcgataatctgagatgctgggacttactgtggcatccgacatacagtcaagattccgtgagatgttgatactactttttttgttgttaagttgggagatctgagagaccggcttttgcaagagcggatgtcattccacatcacctttctcaatgaaaaagcctcattctggcctctcttagagccccttctccgatgtttgttagcagtcacatttcctaatgtagcactcaagctccacttaattattccttagctcactttgcacacgtttgcatccacatataagggagaggaatccattaagaagtagctgaaatgtgtattctgtgtttgtgtgttaacactgagaataagccttggaattaggagtagggcaaatgactgagccttgtctcacccatggattactctttactgaaagggatggtagtacagtagaggggtaaatgggggaggggagggttgataatgaatccaaaaagtttagaacctaactataccctctggctactgagacaagagtccattaaagcagtagttggaccttttctttagataagatggtttatatgaagacactatatcaaaggaggaagaacatatatttaaaggatgaaaaaatcagtaggactcttctctgagcttctggaaggagactcctaggctttaaaaaggcgccgggtggtccagttaggtgtttgactttggctgaggtcatgaacttgcatttcgtgagttccagccccacatcagtctctgtgctgacagctcaga

SEQ ID NO: 106 - protein, 784 aa, Felis catus
MRARPLWAAVLVLGALAGVGVGVSNICTTRGIHSCQECLAVSPACAWCSDEALPLGSPRCNLKENLLKDNCALESVEFPVSEARILEARPLSDKGSGDSSQITQVSPQRIALRLRPDDSKIFSVRVRQVEDYPVDIYYLMDLSYSMKDDLWSIQNLGTKLASQMRKLTSNLRIGFGAFVDKPVSPYMYISPPEALKNPCYDMKNTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVSLYQNYSELIPGTTVGVLSANSSNVLQLIVDAYGKIRSKVELEVRDLPEELSLSFNATCLNNEVIPGLKSCVGLKIGDTVSFSIEAKVRGCPQEREKSFTIKPVGFKDSLTVQVTFDCDCACQAHAEPYSRRCNNGNGTFECGVCRCGPGWLGSQCECSEEDYRPSQQEECSPQEGQPACSQRGECLCGQCVCHSSDFGKITGKYCECDDFSCVRYKGEMCSGHGQCSCGDCLCDSDWTGFYCNCTTRTDTCMSSNGLLCSGRGKCECGSCVCIQLGSYGDTCEKCPTCPDTCTFKKECVECKKFDRGDLRKENTCSRYCRDEIESVKELKDTGKDAVNCTYKNEDDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 107 - DNA, 5693 bp, Bos taurus
  CDS (7)..(2361)
gacgagatgcgagcgcggcggctctgggcagcggtgctggtggtgggggcgctggcgggcgtcggcgtcggagggcccaacatctgtgccacacgaggtgtgagctcctgccagcaatgtctggctgtgagtcccacatgtgcctggtgctcagatgaggcgctgcctccaggctcgccccgctgtaacttgaaggagaacctgctgaaggataactgccacccggagtccatcgagttccctatcagcgaggccagaatcctggaggccaggcccctcagtgacaagggcactggagacagctcccagattacccaagtcagtccccagaggattgccctccgcctacggccagatgattcgaagattttctccgtccaagttcggcaggtggaagattaccctgtggacatctactacttaatggacttgtcttactccatgaaggatgacctgcggaacatccagaacctgggtaccaagctggcctcccagatgcgtaagctcaccagtaacctgcggattggcttcggggcctttgtggacaagcccgtgtcaccatacatgtatatttctccaccagaggctatcagaaacccttgctatgatatgaaggctacctgtttgcccatgtttggctacaaacatgtgctgacactaactgaccaggtgacccgcttcaatgaggaggtgaagaagcagagtgtgtcacggaaccgagatgccccagagggtggttttgatgccatcatgcaggctaccgtctgtgatgagaagattggctggaggaatgatgcctcccacttgctggtgtttaccactgatgccaagacccatatagcgctggatggaaggctggcaggcatcgtccagcccaatgatgggcagtgtcatgtgggcagtgacaaccattattctgcctccaccaccatggattatccttccttggggctgatgactgagaagctatcccagaaaaacatcaatttgatctttgcagtgactgaaagtgtagtcaatctctaccagaactatagtgagctcatcccagggaccacagtgggggttctgtctactgattccagcaatgttctccagctcattgtggatgcttatgggaaaatccgctctaaagtagagctggaagtgcgtgacctccccgaagagctgtccttatccttcaacgccacatgtctcaacaacgaagtcatcccaggcctgaagtcttgcgttggactcaagattggagacacggtgagcttcagcattgaggccaaagtgcgtggctgtccccagaagaaggagaagtccttcaccatcaagcctgtgggcttcaaagacagcctcaccgtgcaggttactttcgactgtgactgtgcctgccaggccgaggctgagccttttagccaccgctgcaacaatggcaatgggacctttgagtgtggggtgtgccgctgtgggcccggctggctggggtcccagtgcgagtgctcagaagaggactaccgcccctcgcagcaggacgagtgcagcccccgggagggccagcccatctgtagccagcggggcgagtgtctctgtggccagtgcgtctgccacagcagtgactttggcaagatcacgggcaagtactgtgaatgtgatgacttctcctgtgtccgctacaagggggagatgtgctcaggccatggccagtgcagctgtggggactgtctgtgtgactccgactggaccggctactactgcaactgtaccacacgcacggacacctgcatgtccagcaacggcttgctgtgcagcggacggggcaagtgtgagtgcggcagctgtgtctgcatccagccgggctcctatggggacacctgtgagaagtgtcccacctgccctgacgcctgcacctttaagaaggagtgtgtggaatgtaagaagtttaaccggggagccctcaacgaggaaaatacctgcaaccgttattgtcgtgatgagattgagcctgtgaaggaacttaaggacactggcaaggatgctgtgaattgtacctacaagaatgaggatgactgtgttgtcagattccagtactacgaagactccagtggaaagtccattttgtatgtggtggaagagccagagtgtcccaagggccctgacatcctggtggtcttgctatccgtgatgggggccattctgctcatcggccttgcgactctgctcatctggaagctcctcatcaccatccatgaccggaaggagtttgctaaatttgaagaagagagagccagagccaaatgggacactgccaacaacccactgtataaagaggctacatccaccttcaccaacatcacctacaggggcacttaacgagcagtcatcccaggatcgctctcggactgtcccaggattgtggacgtctctgctcttatgtttacagggggcaatacctgtggggcgggattgagggcttggagtggggtgggttggaagactgtgggtctgtgtgtgtgtgtgatatgtgtgggggagtgtataatttaaaacctgtgtcccagatgagcgaagctcctcagtctttgtcctcagaaggcctccttccttcagggagttttcctgcttaacctgagggtgacctacatcgctgagcaggtgttctttattacctcagtgggaagccaactttccttctcaggacagtctcttgaagaggagggcagggccgaggactctcgttccagagacagggaccttggtttaccctgtatttctggttctcaggcctgactctgagcagctctggtgggagctgctgggtcttgaggccttgttgtgtcactcgagcctccgtctcctgtcccttccctcaggctgagggagacgttaggggaaagctggaccatcaggcctgcctgtctttgctgtcacctcaacccagcagagttctctactaagggaagtccttgctatctagtctttgatctattgggagaaaggctggtggtggggggcagggacatgcataacctggggttaaagtgcccgggctcccccattcatgatcataacccttctgatttgccttattggcagctctaccctagaggttcctttagaaattgtgtgtcacccttagccagcatcacttctttggctcccatcccatcttttcactgcttatagacatttgctatgtactaggaggggcttcccaggtggcccagtgggtaagggatccacctgcaatgcaggagatgcagaaggcatgggttggatccctgggtcaggaagatcccttggaggtgggtatggcaatccactccagtattcttgcctggagaatcccatggacagagaagtctggcatcctacagttcatggggtcatggagtcagacacaactgaagtgaccaagcatgtacgctcgcacacatactgggaatttccctcatgacccaaggcttttccttccagggagagtgctatggttagagtcagaggtctggccccacccttcaggccttctgtcccatgttcaaggcacctccacacacccaattttgtgcttctgtgtgctatacccacccatggggctgactgcatgtatctacctcttgggtgtcttgtgaaggaatcattcccatgggactgagtctcctgggcacacgtgccagggtggaaggatgggccaggtgtatcggcacatgtgcgccatcctcctctgggctgggcaacctcatttgaactcagtctttaatttgagaggccacaagtggagttttgtttttctcatcgagacacctgaaatcaggacgaggcttgctgaatctaaaggagcaaaaatataaacacacttgcattatatttgtaattttatttgatgatgaggaagaaaatgatgaaaagccatatcgacttgagctgggtgcagacactcccacttggcatcattcataagaagtcgctaccccgttgctgggtctgaaagggctctctcattctgggagcctgcagggttagacacatggatatgctggacctctcccaaggaggaggaggaaaatgggctgtgcttttttttttcccctagcaaaagaagttggagaaggcaatggcaccccactccagtacttttgcctggaaaatcccaaggatggaggagcctggtaggctgcagtccatggggtcgctaagagtcggacacgactgagtgacttcactttcacttttcactttcacgcattggagaaggaaatggcaacccactctagtgtgcttgccttaagaatcccagggacgggggagcctggtgggctgctgtctatggggtcgcacagagtcggacacaactgaagtgacttagcagcagcagcagcaaaagcagttgctccatcggtgtttacatttgttccacattaaccaccaccaccattccctgagaaaaagggaagggcctataaaaacaggggtctgatgatcagaaaatctaggtcctgacctcagtgttgcagctaaggagctttaaccttaattaaggcaagtcttctccctggggctcagttttctagtttgaaaaatgatggatttggcctagccaatctaggaggtctctgtcagtatccacattccataatgctgggacttactgtggcatcaaataggcagtcaagattctgtgggatgttgatactgtttgttttttcatttgggagatctggctctggcaagagcaggtggcatcccatatcacctttctcaacgaaaaaagcctcattctaccttctctgagaacacccttttccaacttttgttagcagttacatctcctgatacagcacttaaaactccacttagttattatttcttttttcactttgcacatggtttaatccatgtattggggaagaggaatccataagaaactagctgaaatgtgtgttctgtatccattcctaagaatggggcagatatctgagccccgtgtcactcatggattactccttcccgtaggaaatggtaatgttgtagagggataaatgggaagagacgattataaatccaggaagtttagaatctaattctaactgttggctcctgagaaatgactccattgacgtggcagtcattttctttaaataagatggtttatatgaagaaacggtaccaaaggaggagaaaactgtattctaaggaggaaaaaattagtaggaatctttctgagcttctggaataaggcttacaggctttgaagatcagtacatttgtatgtggggagaaaccatagctgttttcatgagctagcaaatagcagtcagttttgacgtcagggggaaatagggtgacacagaatcggacacgactgaagcgacttagcagcaagagcagcagggtgaacccctaaatagtattttagtatcagaaaacacagcccaaagaagttatttgttctgagctcttttggagatattttacgttcaatctcagggtctgtggacaaaaatgggaaactttgaacattgctgacaagttgtcacctaaggagtcaagttctttacctctcagatattcctagaccatccatgatttcaagatatttctctttgttaagtattcctggttgacctaaatgccttcctgactttctaaccacctcctctgtctgaattgtgcaacagtgaattaaatgtgctttccaaaaagaa

SEQ ID NO: 108 - protein, 784 aa, Bos taurus
MRARRLWAAVLVVGALAGVGVGGPNICATRGVSSCQQCLAVSPTCAWCSDEALPPGSPRCNLKENLLKDNCHPESIEFPISEARILEARPLSDKGTGDSSQITQVSPQRIALRLRPDDSKIFSVQVRQVEDYPVDIYYLMDLSYSMKDDLRNIQNLGTKLASQMRKLTSNLRIGFGAFVDKPVSPYMYISPPEAIRNPCYDMKATCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTESVVNLYQNYSELIPGTTVGVLSTDSSNVLQLIVDAYGKIRSKVELEVRDLPEELSLSFNATCLNNEVIPGLKSCVGLKIGDTVSFSIEAKVRGCPQKKEKSFTIKPVGFKDSLTVQVTFDCDCACQAEAEPFSHRCNNGNGTFECGVCRCGPGWLGSQCECSEEDYRPSQQDECSPREGQPICSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFNRGALNEENTCNRYCRDEIEPVKELKDTGKDAVNCTYKNEDDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 109 - DNA, 4566 bp, Sus scrofa
  CDS (32)..(2386)
ctgaggcggagggcggcagcgggtggacgagatgcgagcgcggccgctctgggccgctgtgctggtggtgggggcgctggcgggcgtcggcgtcggagggcccaacatctgtgccacacgaggtgtgagctcctgccagcaatgtctggctgtgagtcccatgtgtgcctggtgctcagatgaggatctgcctctgggcacgccccgctgtaacctggaggagaatctgctgaacgatcactgtaacccgaagtacattgagttccccatcagtgaggccagaatcctggaggccaggcccctgagtgacaagggctctggagacagctcccagataactcaagtcagcccccagaggatcttgctccggctccggccagatgattcgaagagtttctccgtccaagtccggcaggtggaggattaccctgtggacatctactacttgatggacctgtctttctctatgaaggatgatctggagagcatccagaacctgggtaccaagctggcttcccagatgcgtaagctcaccagtaacctgcggattggcttcggggcctttgtggacaagcctgtgtcaccttacatgtacatctctccaccacaggccctcaaaaacccctgctatgatatgaagaccacctgtttgcccatgtttggctacaaacatgtgctcacactaactgaccaggtgacccgtttcaacgaggaagtgaagaagcagaatgtatcacggaaccgagatgctccagagggtggctttgatgccatcatgcaggctactgtctgtgacgagaagattggctggaggaacgatgcatcccacttactggtgtttaccactgatgccaagacccatatagcgctggatggaaggctggcaggcattgtccaacccaatgatggacagtgtcatgttggcagtgacaaccattactctgcctccactaccatggattatccctctctggggctgataactgagaagctatcccagaaaaacatcaatttgatctttgcagtgacagaaggtgtagttagtctttaccagaactacagtgaactgatcccagggaccacagtgggggtgctgtcctccaattccagcaatgtcctccagctcattgtggatgcttatggcaaaatccgctctaaagtggagctcgaagtgcgtgacctccctgaggagctgtcgttatccttcaatgccacctgtctcaacaacgaggtcatcccaggccttaagtcttgtgttggactcaagattggagacacggtgagcttcagcattgaggccaaggtgcgtggctgcccccgggagaaggagaagtccttcaccatcaagcccgtgggcttcaaagacagcctcactgtccaggtcaccttcaactgtgactgtgactgccaggctcaagctgagcctgacagcccccgctgcaacaatggcaatgggacctttgagtgtggggtgtgccactgtgggcctggctggctggggttccagtgtgagtgctcggaaaaggactaccgcccctcccagcaggatgagtgcagcccccagcagggccagcccatctgcagccagcggggcgagtgtctctgtggccagtgtgtctgccacagcagtgactttggcaagatcacgggcaagtactgtgagtgtgacgacttctcctgtgtccactacaagggggagatgtgctcaggccatggccagtgcagctgcggggactgtctgtgtgactccgactggactggcttctactgcaactgtaccacgcgcaccgacacctgcttgtctagcaacgggctgctgtgcagcgggcggggcaattgcgaatgcggcagctgcgtctgcatccagccaggctcctacggggacacctgtgagaagtgtcccacttgccctgatgcctgcacctttaagaaggggtgtgtggagtgtaaaaagtttaaccggggatccctctacgaggcaaatacttgcaaccgttactgtcgtgatgagattgagtctgtgaaggagcttcaggacagtggcaagaatgcagtgaattgtacctacaagaatgaggatgactgtgtcgtcagattccagtactatgaagactccagtggaaagtccatcctgtatgtggtagaagagccagagtgtcccaagggccctgacatcctggtggtcctgctttcagtgatgggggccattctgctcatcggccttgctactctgctcatctggaagctcctcatcaccatccatgaccggaaggagtttgctaaatttgaagaagagagagccagagccaaatgggacacagccaacaatcccctgtataaagaggccacatccaccttcaccaacatcacctaccggggcacttagtgacaagcaatcatcctcagatcactgtcagactgtcccaggattgtgggtgtctctgctgtcatgtttacagggggcaatatctgtggggcagaactgggggcttggagtgggatgggttggaagagagagagagagagagagagagagtgtgtgtgtgtgtgtgtgtgcgtgcgcacgcactgtgtgtgggggcgtgtataatttaaaacttgtgatatgttccagataagtggggcttctcagcctttgtcctcaaaatgcctccttcagggagtcttcctgcttcacctgagggtgacctacacagctgagcaggtttcttcattacctcagtgggaagccagctttccttctcaggccattttcttgaagagaagggcaaggctcaggcctctcgttccagagaaatggaccttgatttacccagtctgtggttcttgggcctggctctcagcagctctggtaggaactgccaggctttgtatggcttctgtgcctcactctcctctcctttccctcaggccaaaggagaaatcggcggggggttgggggggaaccgaaccatcagggctgtctgtctttgccatcaccccaacccatcatggttctctcataagggaagtccttgctgcctcatcttctatttgggagtgaggatggcagggccacccaggggtcatgcatggccttggggaaggtgcctgagtccccagttcataattataacccttcggatttgcctcgttggcagctccaccctagaggttcccttagaagtgtatcacccttagaccagcatcacctctttacctcctattccaccctctcatggctgttgacatttgctaggtactaggaatctctctcactaccaaaagcttttcctctcagggagagtgctatggttagagccagaggtctggtctcacccatcaggccttttgccccttgtcccaggcacctccacacacccaaccctgtatttctatgtgctgtgccacccatggggctgattgtatttatctacctcttgggtgtcttgtgaaggaatcattcccatgggtctctgagtctgctggggacaaatgccagggtggaatgatgggcccattgtatcagcatgtgtggcccattctcccaggggccaggcaacctcgttataactcagtctttaatctgagagtgcaattgttttatttttctcattggagcacctgaaaccatggtgaggcctgcttaatataaaggagcataaacataaacacatgtccattatatttgtaattttatttgatgatgaggaagtagaagataaaaaaaaccacacagacttgggctggatgcagactctcgcacttggcaaattcatagcagtgactgcccagtggctgggtctgtaagggctctctgatcctggaagcctgtggggatagacacatggacaagccagacctttcccgaggaggaaaaatgggctcttctttttttctagcaaaagcagttgctccattgatgtttacattcattcaatattaacagctccaccactccccaagaaaaaggaaatggcctataaacagtggtctgagggtcagaaaatctaaggcctggcctcagtgttgcagctaaggaactttaaccttaaggcaagtcactttcttctccctggggctagtttcattttccagattgaaacatgatgggtttggaccagccagtctagaaagtctccttctgtatcaacattctatgttgctgggacttactgtggcatcaagcatgcagtcaagattctgggggatgttgattagcgtttatttttttcagttgggagattggagagacctggtttggtaagagcagatgttctccaatatcacctttctcaatgaaaaaccctcatcctggagttcccatcgtggctcagtggttaacgaatccgactaggaaccatgaggttgcgggttcgatccctggccttgctcagtgggttaaggatccggtgttgccgtgagctgtggtgtaggttgcagacacggcttggatccagcgttgctgtgactctggcgtaggccagcagctacagctctgattggactcctagcctgggaacctccacatgccgcaggagtggcccaagaaatggcaaaaagaccaaaaaaaaaaaaaaaaaaaaa

SEQ ID NO: 110 - protein, 784 aa, Sus scrofa
MRARPLWAAVLVVGALAGVGVGGPNICATRGVSSCQQCLAVSPMCAWCSDEDLPLGTPRCNLEENLLNDHCNPKYIEFPISEARILEARPLSDKGSGDSSQITQVSPQRILLRLRPDDSKSFSVQVRQVEDYPVDIYYLMDLSFSMKDDLESIQNLGTKLASQMRKLTSNLRIGFGAFVDKPVSPYMYISPPQALKNPCYDMKTTCLPMFGYKHVLTLTDQVTRFNEEVKKQNVSRNRDAPEGGFDAIMQATVCDEKIGWRNDASHLLVFTTDAKTHIALDGRLAGIVQPNDGQCHVGSDNHYSASTTMDYPSLGLITEKLSQKNINLIFAVTEGVVSLYQNYSELIPGTTVGVLSSNSSNVLQLIVDAYGKIRSKVELEVRDLPEELSLSFNATCLNNEVIPGLKSCVGLKIGDTVSFSIEAKVRGCPREKEKSFTIKPVGFKDSLTVQVTFNCDCDCQAQAEPDSPRCNNGNGTFECGVCHCGPGWLGFQCECSEKDYRPSQQDECSPQQGQPICSQRGECLCGQCVCHSSDFGKITGKYCECDDFSCVHYKGEMCSGHGQCSCGDCLCDSDWTGFYCNCTTRTDTCLSSNGLLCSGRGNCECGSCVCIQPGSYGDTCEKCPTCPDACTFKKGCVECKKFNRGSLYEANTCNRYCRDEIESVKELQDSGKNAVNCTYKNEDDCVVRFQYYEDSSGKSILYVVEEPECPKGPDILVVLLSVMGAILLIGLATLLIWKLLITIHDRKEFAKFEEERARAKWDTANNPLYKEATSTFTNITYRGT

SEQ ID NO: 111 - DNA, 4511 bp, Sus scrofa
  CDS (1)..(2355)
atgcgagcgcggccgctctgggcagctgtgttggtggtgggggcgctggcgggcgtcggcgtcggagggcccaacatctgtgccacacgaggtgtgagctcctgccagcaatgtctggctgtgagtcccatgtgtgcctggtgctcagatgaggatctgcctctgggcacgccccgctgtaacctggaggagaatctgctgaacgatcactgtaacccgaagtacattgagttccccatcagtgaggccagaatcctggaggccaggcccctgagtgacaagggctctggagacagctcccagataactcaagtcagcccccagaggatcttgctccggctccggccagatgattcgaagagtttctccgtccaagtccggcaggtggaggattaccctgtggacatctactacttgatggacctgtctttctctatgaaggatgatctggagagcatccagaacctgggtaccaagctggcttcccagatgcgtaagctcaccagtaacctgcggattggcttcggggcctttgtggacaagcctgtgtcaccttacatgtacatctctccaccacaggccctcaaaaacccctgctatgatatgaagaccacctgtttgcccatgtttggctacaaacatgtgctcacactaactgaccaggtgacccgtttcaacgaggaagtgaagaagcagaatgtatcacggaaccgagatgctccagagggtggctttgatgccatcatgcaggctactgtctgtgacgagaagattggctggaggaacgatgcatcccacttactggtgtttaccactgatgccaagacccatatagcgctggatggaaggctggcaggcattgtccaacccaatgatggacagtgtcatgttggcagtgacaaccattactctgcctccactaccatggattatccctctctggggctgataactgagaagctatcccagaaaaacatcaatttgatctttgcagtgacagaaggtgtagttagtctttaccagaactacagtgaactgatcccagggaccacagtgggggtgctgtcctccaattccagcaatgtcctccagctcattgtggatgcttatggcaaaatccgctctaaagtggagctcgaagtgcgtgacctccctgaggagctgtcgttatccttcaatgccacctgtctcaacaacgaggtcatcccaggccttaagtcttgtgttggactcaagattggagacacggtgagcttcagcattgaggccaaggtgcgtggttgcccccgggagaaggagaagtccttcaccatcaagcccgtgggcttcaaagacagcctcactgtccaggtcaccttcaactgtgactgtgactgccaggctcaagctgagcctgacagcccccgctgcaacaatggcaatgggacctttgagtgtggggtgtgccactgtgggcctggctggctggggttccagtgtgagtgctcggaaaaggactaccgcccctcccagcaggatgagtgcagcccccagcagggccagcccatctgcagccagcggggcgagtgtctctgtggccagtgtgtctgccacagcagtgactttggcaagatcacgggcaagtactgtgagtgtgacgacttctcctgtgtccactacaagggggagatgtgctcaggccatggccagtgcagctgcggggactgtctgtgtgactccgactggactggcttctactgcaactgtaccacgcgcaccgacacctgcttgtctagcaacgggctgctgtgcagcgggcggggcaattgcgaatgcggcagctgcgtctgcatccagccaggctcctacggggacacctgtgagaagtgtcccacttgccctgatgcctgcacctttaagaaggggtgtgtggagtgtaaaaagtttaaccggggatccctctacgaggcaaatacttgcaaccgttactgtcgtgatgagattgagtctgtgaaggagcttcaggacagtggcaagaatgcagtgaattgtacctacaagaatgaggatgactgtgtcgtcagattccagtactatgaagactccagtggaaagtccatcctgtatgtggtagaagagccagagtgtcccaagggccctgacatcctggtggtcctgctttcagtgatgggggccattctgctcatcggctttgctactctgctcatctggaagctcctcatcaccatccatgaccggaaggagtttgctaaatttgaagaagagagagccagagccaaatgggacacagccaacaatcccctgtataaggaggccacatccaccttcaccaacatcacctaccggggcacttagtgacaagcaatcatcctcagatcactgtcagactgtcccaggattgtgggtgtctctgctgtcatgtttacagggggcaatatctgtggggcagaactgggggcttggagtgggatgggttggaagagagagagagagagagagagtgtgtgtgtgtgtgtgtgtgcgtgcgcacgcactgtgtgtgggggcgtgtataatttaaaacttgtgatatgttccagataagtggggcttctcagcctttgtcctcaaaatgcctccttcagggagtcttcctgcttcacctgagggtgacctacacagctgagcaggtttcttcattacctcagtgggaagccagctttccttctcaggccattttcttgaagagaagggcaaggctcaggcctctcgttccagagaaatggaccttgatttacccagtctgtggttcttgggcctggctctcagcagctctggtaggaactgccaggctttgtatggcttctgtgcctcactctcctctcctttccctcaggccaaaggagaaatcggcggggggttgggggggaaccgaaccatcagggctgtctgtctttgccatcaccccaacccatcatggttctctcataagggaagtccttgctgcctcatcttctatttgggagtgaggatggcagggccacccaggggtcatgcatggccttggggaaggtgcctgagtccccagttcataattataacccttcggatttgcctcgttggcagctccaccctagaggttcccttagaagtgtatcacccttagaccagcatcacctctttacctcctattccaccctctcatggctgttgacatttgctaggtactaggaatctctctcactaccaaaagcttttcctctcagggagagtgctatggttagagccagaggtctggtctcacccatcaggccttttgccccttgtcccaggcacctccacacacccaaccctgtatttctatgtgctgtgccacccatggggctgattgtatttatctacctcttgggtgtcttgtgaaggaatcattcccatgggtctctgagtctgctggggacaaatgccagggtggaatgatgggcccattgtatcagcatgtgtggcccattctcccaggggccaggcaacctcgttataactcagtctttaatctgagagtgcaattgttttatttttctcattggagcacctgaaaccatggtgaggcctgcttaatataaaggagcataaacataaacacatgtccattatatttgtaattttatttgatgatgaggaagtagaagataaaaaaaaccacacagacttgggcgggatgcagactctcgcacttggcaaattcatagcagtgactgcccagtggctgggtctgtaagggctctctgatcctggaagcctgtggggatagacacatggacaagccagacctttcccgaggaggaaaaatgggctcttctttttttctagcaaaagcagttgctccattgatgtttacattcattcaatattaacagctccaccactccccaagaaaaaggaaatggcctataaacagtggtctgagggtcagaaaatctaaggcctggcctcagtgttgcagctaaggaactttaaccttaaggcaagtcactttccttctccctggggctagtttcattttccagattgaaacatgatgggtttggaccagccagtctagaaagtctccttctgtatcaacattctatgttgctgggacttactgtggcatcaagcatgcagtcaagattctgggggatgttgattagcgtttatttttttcagttgggagattggagagacctggtttggtaagagcagatgttctccaatatcacctttctcaatgaaaaaccctcatcctggagttcccatcgtggctcagtggttaacgaatccgactaggaaccatgaggttgcgggttcgatccctggccttgctcagtgggttaaggatccggcgttgccgtgagctgtggtgtaggttgcagacacggcttggatccagcgttgctgtgactctggcgtaggccagcagctacagctctgattggactcctagcctgggaacctccacatgccgcaggagtggcccaagaaatggcaaaaagacc

SEQ ID NO: 112 - protein, 784 aa, Sus scrofa
MRARPLWAAVLVVGALAGVGVGGPNICATRGVSSCQQCLAVSPMCAWCSDEDLPLGTPRCNLEENLLNDHCNPKYIEFPISEARILEARPLSDKGSGDSSQITQVSPQRILLRLRPDDSKSFSVQVRQVEDYPVDIYYLMDLSFSMKDDLESIQNLGTKLASQMRKLTSNLRIGFGAFVDKPVSPYMYISPPQALKNPCYDMKTTCLPMFGYKHVLTLTDQVTRFNEEVKKQNVSRNRDAPEGGFDAIMQATVCDEKIGWRNDASHLLVFTTDAKTHIALDGRLAGIVQPNDGQCHVGSDNHYSASTTMDYPSLGLITEKLSQKNINLIFAVTEGVVSLYQNYSELIPGTTVGVLSSNSSNVLQLIVDAYGKIRSKVELEVRDLPEELSLSFNATCLNNEVIPGLKSCVGLKIGDTVSFSIEAKVRGCPREKEKSFTIKPVGFKDSLTVQVTFNCDCDCQAQAEPDSPRCNNGNGTFECGVCHCGPGWLGFQCECSEKDYRPSQQDECSPQQGQPICSQRGECLCGQCVCHSSDFGKITGKYCECDDFSCVHYKGEMCSGHGQCSCGDCLCDSDWTGFYCNCTTRTDTCLSSNGLLCSGRGNCECGSCVCIQPGSYGDTCEKCPTCPDACTFKKGCVECKKFNRGSLYEANTCNRYCRDEIESVKELQDSGKNAVNCTYKNEDDCVVRFQYYEDSSGKSILYVVEEPECPKGPDILVVLLSVMGAILLIGFATLLIWKLLITIHDRKEFAKFEEERARAKWDTANNPLYKEATSTFTNITYRGT

SEQ ID NO: 113 - DNA, 2553 bp, Saimiri boliviensis boliviensis
  CDS (15)..(2327)
gccaggagaagtagatggagctgcagtctgaaagcccaggacccaacacctgtaccacgcgaggtgtgagttcctgccagcagtgtctggctgtgagtcccatgtgtgcctggtgctctgataaggccctgcctctgggctcacctcgctgtgacctgaaggagaatctgctgaaggataactgtgccccggagtccatcgagttcccagtcagtgaggcccgagtactagaggacaggcccctcagcgacaagggctctggagacagctcccaggtcactcaagtcagtccccagaggattgcactccggctccggccagatgattcaaagaacttctccatccaagtgcgccaagtggaggattaccctgtggacatctactacttgatggacctgtcttactccatgaaggatgatctgtcgagcatccggaacctgggtaccaagctggccacccagatgcgaaagctcaccagtaacctgcggattggctttggggcatttgtggacaagcccgtgtcaccatacatgtatatctccccaccagaggccctcaaaaacccctgctatgatatgaagaccacctgtttgcccatgtttggctacaaacacgtgctgacgctaactgaccaggtgacccgcttcaatgaggaagtgaggaagcagagtgtgtcacggaaccgagatgccccagagggtggctttgatgccattatgcaggctacagtctgtgatgaaaagattggctggaggaatgatgcctcccacttgctggtgtttaccactgatgccaagactcacatagcactggatggaaggctggcaggcattgtccagcccaatgatgggcagtgtcatgttggtagtgacaatcattactctgcctccactaccatggattatccctctctggggctgatgactgagaagctatcccagaaaaacatcaatctgatctttgcagtgactgaaaatgtagtcaatctctatcagaactatagtgagctcatcccagggaccacagtaggggttctgtccatggattccagcaatgtcctccagctcattgttgatgcttatgggaaaatccgctctaaagtagagctggaagtacgtgaccttcctgatgagttgtctctgtccttcaatgccacctgcctcaacaatgaggtcatccctggcctcaagtcttgtatgggactcaagattggagacacggtgagcttcagcattgaggccaaagtgcgaggctgcccccaggagaaggagaagtcctttaccatcaagcctgtgggcttcaaggacagcctggtcgtccaggtcacctttgattgtgactgtgcttgtcaggcacaagctgaacctaatagccgtcactgcaacaatggcagtgggacctttgagtgtggggtgtgtcgctgcgaccctggctggctggggtcccagtgtgagtgctcagaggaagactatcgcccttcccagcaagacgagtgcagcccccgggagggccagcctgtctgtagccagcggggcgagtgcctctgtggtcagtgtgtctgccacagcagtgactttggcaagatcacgggcaagtactgcgagtgtgatgacttctcctgtgttcgctacaagggggagatgtgctcaggccatggccagtgcagctgtggggactgcctgtgtgactccgactggactggctactactgcaactgtaccacgcgcaccgacacctgcatgtccagcaacgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagcattacataagaaaaatacctgcaaccgttactgccgtgatgaaatcgagtcagtgaaagagcttaaggacactggcaaagatgcagtgaattgtacctataagaacgaggatgactgtgttgtcagattccagtactatgaagactccagtggaaagtccatcctgtatgtggtagaagagccagagtgtcccaagggccctgacatcctagttgtcctgctgtcagtgatgggggccattctgctcatcggccttgctgctctgctcatctggaagctcctcatcactatccacgaccgaaaagagtttgctaaatttgaggaagaacgcgccagggcaaaatgggacacagccaacaacccactgtataaagaggccacatctaccttcaccaatatcacctaccggggcacttaatgataagcagtcgtcttcagatcattatcagcctgtgccaggattgcaggagtctctgccatcatgtttacagaggacagtatttgtggggagggatttagggctcagagagtggtgggttgggagaatgttggtatgtggaagtatgggtctgtgtgtgtggggtggggagtgtgtgtgttgcatgtgggagtgtgtaatttaaaattgtgatatgttctgataa

SEQ ID NO: 114 - protein, 770 aa, Saimiri boliviensis boliviensis
MELQSESPGPNTCTTRGVSSCQQCLAVSPMCAWCSDKALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLSSIRNLGTKLATQMRKLTSNLRIGFGAFVDKPVSPYMYISPPEALKNPCYDMKTTCLPMFGYKHVLTLTDQVTRFNEEVRKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPDELSLSFNATCLNNEVIPGLKSCMGLKIGDTVSFSIEAKVRGCPQEKEKSFTIKPVGFKDSLVVQVTFDCDCACQAQAEPNSRHCNNGSGTFECGVCRCDPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHKKNTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 115 - DNA, 2532 bp, Saimiri boliviensis boliviensis
  CDS (81)..(2306)
cgggcgtcggcgtcggaggacccaacacctgtaccacgcgaggtgtgagttcctgccagcagtgtctggctgtgagtcccatgtgtgcctggtgctctgataaggccctgcctctgggctcacctcgctgtgacctgaaggagaatctgctgaaggataactgtgccccggagtccatcgagttcccagtcagtgaggcccgagtactagaggacaggcccctcagcgacaagggctctggagacagctcccaggtcactcaagtcagtccccagaggattgcactccggctccggccagatgattcaaagaacttctccatccaagtgcgccaagtggaggattaccctgtggacatctactacttgatggacctgtcttactccatgaaggatgatctgtcgagcatccggaacctgggtaccaagctggccacccagatgcgaaagctcaccagtaacctgcggattggctttggggcatttgtggacaagcccgtgtcaccatacatgtatatctccccaccagaggccctcaaaaacccctgctatgatatgaagaccacctgtttgcccatgtttggctacaaacacgtgctgacgctaactgaccaggtgacccgcttcaatgaggaagtgaggaagcagagtgtgtcacggaaccgagatgccccagagggtggctttgatgccattatgcaggctacagtctgtgatgaaaagattggctggaggaatgatgcctcccacttgctggtgtttaccactgatgccaagactcacatagcactggatggaaggctggcaggcattgtccagcccaatgatgggcagtgtcatgttggtagtgacaatcattactctgcctccactaccatggattatccctctctggggctgatgactgagaagctatcccagaaaaacatcaatctgatctttgcagtgactgaaaatgtagtcaatctctatcagaactatagtgagctcatcccagggaccacagtaggggttctgtccatggattccagcaatgtcctccagctcattgttgatgcttatgggaaaatccgctctaaagtagagctggaagtacgtgaccttcctgatgagttgtctctgtccttcaatgccacctgcctcaacaatgaggtcatccctggcctcaagtcttgtatgggactcaagattggagacacggtgagcttcagcattgaggccaaagtgcgaggctgcccccaggagaaggagaagtcctttaccatcaagcctgtgggcttcaaggacagcctggtcgtccaggtcacctttgattgtgactgtgcttgtcaggcacaagctgaacctaatagccgtcactgcaacaatggcagtgggacctttgagtgtggggtgtgtcgctgcgaccctggctggctggggtcccagtgtgagtgctcagaggaagactatcgcccttcccagcaagacgagtgcagcccccgggagggccagcctgtctgtagccagcggggcgagtgcctctgtggtcagtgtgtctgccacagcagtgactttggcaagatcacgggcaagtactgcgagtgtgatgacttctcctgtgttcgctacaagggggagatgtgctcaggccatggccagtgcagctgtggggactgcctgtgtgactccgactggactggctactactgcaactgtaccacgcgcaccgacacctgcatgtccagcaacgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagcattacataagaaaaatacctgcaaccgttactgccgtgatgaaatcgagtcagtgaaagagcttaaggacactggcaaagatgcagtgaattgtacctataagaacgaggatgactgtgttgtcagattccagtactatgaagactccagtggaaagtccatcctgtatgtggtagaagagccagagtgtcccaagggccctgacatcctagttgtcctgctgtcagtgatgggggccattctgctcatcggccttgctgctctgctcatctggaagctcctcatcactatccacgaccgaaaagagtttgctaaatttgaggaagaacgcgccagggcaaaatgggacacagccaacaacccactgtataaagaggccacatctaccttcaccaatatcacctaccggggcacttaatgataagcagtcgtcttcagatcattatcagcctgtgccaggattgcaggagtctctgccatcatgtttacagaggacagtatttgtggggagggatttagggctcagagagtggtgggttgggagaatgttggtatgtggaagtatgggtctgtgtgtgtggggtggggagtgtgtgtgttgcatgtgggagtgtgtaatttaaaattgtgatatgttctgataa

SEQ ID NO: 116 - protein, 741 aa, Saimiri boliviensis boliviensis
MCAWCSDKALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLSSIRNLGTKLATQMRKLTSNLRIGFGAFVDKPVSPYMYISPPEALKNPCYDMKTTCLPMFGYKHVLTLTDQVTRFNEEVRKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPDELSLSFNATCLNNEVIPGLKSCMGLKIGDTVSFSIEAKVRGCPQEKEKSFTIKPVGFKDSLVVQVTFDCDCACQAQAEPNSRHCNNGSGTFECGVCRCDPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHKKNTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 117 - DNA, 4110 bp, Homo sapiens
  CDS (54)..(2297)
gtcgagcgggagcagaggaggcgagggaggagggccagagaggcagttggaagatggcggacgaggcggccctcgcccttcagcccggcggctccccctcggcggcgggggccgacagggaggccgcgtcgtcccccgccggggagccgctccgcaagaggccgcggagagatggtcccggcctcgagcggagcccgggcgagcccggtggggcggccccagagcgtgaggtgccggcggcggccaggggctgcccgggtgcggcggcggcggcgctgtggcgggaggcggaggcagaggcggcggcggcaggcggggagcaagaggcccaggcgactgcggcggctggggaaggagacaatgggccgggcctgcagggcccatctcgggagccaccgctggccgacaacttgtacgacgaagacgacgacgacgagggcgaggaggaggaagaggcggcggcggcggcgattgggtaccgagataaccttctgttcggtgatgaaattatcactaatggttttcattcctgtgaaagtgatgaggaggatagagcctcacatgcaagctctagtgactggactccaaggccacggataggtccatatacttttgttcagcaacatcttatgattggcacagatcctcgaacaattcttaaagatttattgccggaaacaatacctccacctgagttggatgatatgacactgtggcagattgttattaatatcctttcagaaccaccaaaaaggaaaaaaagaaaagatattaatacaattgaagatgctgtgaaattactgcaagagtgcaaaaaaattatagttctaactggagctggggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagtaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaacttaaaaaaaaaaaaaaaaa

SEQ ID NO: 118 - protein, 747 aa, Homo sapiens
MADEAALALQPGGSPSAAGADREAASSPAGEPLRKRPRRDGPGLERSPGEPGGAAPEREVPAAARGCPGAAAAALWREAEAEAAAAGGEQEAQATAAAGEGDNGPGLQGPSREPPLADNLYDEDDDDEGEEEEEAAAAAIGYRDNLLFGDEIITNGFHSCESDEEDRASHASSSDWTPRPRIGPYTFVQQHLMIGTDPRTILKDLLPETIPPPELDDMTLWQIVINILSEPPKRKKRKDINTIEDAVKLLQECKKIIVLTGAGVSVSCGIPDFRSRDGIYARLAVDFPDLPDPQAMFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAYLSELPPTPLHVSEDSSSPERTSPPDSSVIVTLLDQAAKSNDDLDVSESKGCMEEKPQEVQTSRNVESIAEQMENPDLKNVGSSTGEKNERTSVAGTVRKCWPNRVAKEQISRRLDGNQYLFLPPNRYIFHGAEVYSDSEDDVLSSSSCGSNSDSGTCQSPSLEEPMEDESEIEEFYNGLEDEPDVPERAGGAGFGTDGDDQEAINEAISVKQEVTDMNYPSNKS

SEQ ID NO: 119 - DNA, 3604 bp, Homo sapiens
  CDS (433)..(1791)
gcatctcctcctccctctccccgggctcctactggcctgaggttgagggcggctgggggctcggggcaggctccgcggcgttcccctccccaccccggccctccgttcagccgcgctcctccggggctgcggttcctactgcgcgagctgccagtggattcgctcttttcctccgtccgtggcccgcctgggcggccttgttctttccgcagcagccagataaccttctgttcggtgatgaaattatcactaatggttttcattcctgtgaaagtgatgaggaggatagagcctcacatgcaagctctagtgactggactccaaggccacggataggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagtaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaacttaaaaaaaaaaaaaaaaa

SEQ ID NO: 120 - protein, 452 aa, Homo sapiens
MFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAYLSELPPTPLHVSEDSSSPERTSPPDSSVIVTLLDQAAKSNDDLDVSESKGCMEEKPQEVQTSRNVESIAEQMENPDLKNVGSSTGEKNERTSVAGTVRKCWPNRVAKEQISRRLDGNQYLFLPPNRYIFHGAEVYSDSEDDVLSSSSCGSNSDSGTCQSPSLEEPMEDESEIEEFYNGLEDEPDVPERAGGAGFGTDGDDQEAINEAISVKQEVTDMNYPSNKS

SEQ ID NO: 121 - DNA, 4096 bp, Gorilla gorilla
  CDS (50)..(2305)
agcgggagcagaggaggcgagggaggagggccagagaggcagttggaagatggcggacgaggcggccctcgcccttcagcccggcggctccccctcggcggcgggggccgacagggaggccgcgtcgtcccccgccggggagccgctccgcaagaggccgcggagagatggtcccggcctcgagcggagcccgggcgagcccggtggggcggccccagagcgtgaggtgccggcggcggccaggggctgcccgggtgcggcggcggcggcggtgtggcgggaggcggaggcggaggcagaggcagaggcggcggcggcgggcggggagcaagaggcccaggcgactgcggcggctgggggaggagacaatgggccgggcctgcagggcccatctcgggagccaccgctggccgacaacttctacgacgaagacgacgacgacgagggcgaggaggaggaagaggcggcggcggcggcgattgggtaccgagataaccttctgttcggtgatgaaattatcactaatggttttcattcctgtgaaagtgatgaggaggatagagcctcacatgcaagctctagtgactggactccaaggccacggataggtccatatacttttgttcagcaacatcttatgattggcacagatcctcgaacaattcttaaagatttattgccggaaacaatacctccacctgagttggatgatatgacactgtggcagattgttattaatatcctttcagaaccaccaaaaaggaaaaaaagaaaagatattaatacaattgaagatgctgtgaaattactgcaagagtgcaaaaaaattatagttctaactggagctggggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccgcccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaagcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagaacaaggaaaccagaaaggtgtaatatttataggttggtaaaatagattgtttttcatggataatttttaacttcattatttctgtacttgtacaaactcaacactaacttttttttaaaaaaaaaaaaaggtactaagtatctttaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagcttatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagtaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagcctagtattatggagatgaacatgatgtaacttgtaatagcagaatagttaatgaatgaaactaattcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatctactggcatatgttttgtagactgtttaatgactggatatcttccttcaacttttgaaatacaaaaccagtgttttttacttgtacactgttttaaagtctattaaaattgtcatttgacttttttctgttaactta

SEQ ID NO: 122 - protein, 751 aa, Gorilla gorilla
MADEAALALQPGGSPSAAGADREAASSPAGEPLRKRPRRDGPGLERSPGEPGGAAPEREVPAAARGCPGAAAAAVWREAEAEAEAEAAAAGGEQEAQATAAAGGGDNGPGLQGPSREPPLADNFYDEDDDDEGEEEEEAAAAAIGYRDNLLFGDEIITNGFHSCESDEEDRASHASSSDWTPRPRIGPYTFVQQHLMIGTDPRTILKDLLPETIPPPELDDMTLWQIVINILSEPPKRKKRKDINTIEDAVKLLQECKKIIVLTGAGVSVSCGIPDFRSRDGIYARLAVDFPDLPDPQAMFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAYLSELPPTPLHVSEDSSSPERTSPPDSSVIVTLLDQAAKSNDDLDVSESKGCMEEKPQEVQTSRNVESIAEQMENPDLKNVGSSTGEKNERTSVAGTVRKCWPNRVAKEQISKRLDGNQYLFLPPNRYIFHGAEVYSDSEDDVLSSSSCGSNSDSGTCQSPSLEEPMEDESEIEEFYNGLEDEPDVPERAGGAGFGTDGDDQEAINEAISVKQEVTDMNYPSNKS

SEQ ID NO: 123 - DNA, 3930 bp, Gorilla gorilla
  CDS (1)..(2139)
atggcggacgaggcggccctcgcccttcagcccggcggctccccctcggcggcgggggccgacagggaggccgcgtcgtcccccgccggggagccgctccgcaagaggccgcggagagatggtcccggcctcgagcggagcccgggcgagcccggtggggcggccccagagcgtgaggtgccggcggcggccaggggctgcccgggtgcggcggcggcggcggtgtggcgggaggcggaggcggaggcagaggcagaggcggcggcggcgggcggggagcaagaggcccaggcgactgcggcggctgggggaggagacaatgggccgggcctgcagggcccatctcgggagccaccgctggccgacaacttctacgacgaagacgacgacgacgagggcgaggaggaggaagaggcggcggcggcggcgattgggtaccgaggtccatatacttttgttcagcaacatcttatgattggcacagatcctcgaacaattcttaaagatttattgccggaaacaatacctccacctgagttggatgatatgacactgtggcagattgttattaatatcctttcagaaccaccaaaaaggaaaaaaagaaaagatattaatacaattgaagatgctgtgaaattactgcaagagtgcaaaaaaattatagttctaactggagctggggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccgcccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaagcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagaacaaggaaaccagaaaggtgtaatatttataggttggtaaaatagattgtttttcatggataatttttaacttcattatttctgtacttgtacaaactcaacactaacttttttttaaaaaaaaaaaaaggtactaagtatctttaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagcttatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagtaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagcctagtattatggagatgaacatgatgtaacttgtaatagcagaatagttaatgaatgaaactaattcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatctactggcatatgttttgtagactgtttaatgactggatatcttccttcaacttttgaaatacaaaaccagtgttttttacttgtacactgttttaaagtctattaaaattgtcatttgacttttttctgttaactta

SEQ ID NO: 124 - protein, 712 aa, Gorilla gorilla
MADEAALALQPGGSPSAAGADREAASSPAGEPLRKRPRRDGPGLERSPGEPGGAAPEREVPAAARGCPGAAAAAVWREAEAEAEAEAAAAGGEQEAQATAAAGGGDNGPGLQGPSREPPLADNFYDEDDDDEGEEEEEAAAAAIGYRGPYTFVQQHLMIGTDPRTILKDLLPETIPPPELDDMTLWQIVINILSEPPKRKKRKDINTIEDAVKLLQECKKIIVLTGAGVSVSCGIPDFRSRDGIYARLAVDFPDLPDPQAMFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAYLSELPPTPLHVSEDSSSPERTSPPDSSVIVTLLDQAAKSNDDLDVSESKGCMEEKPQEVQTSRNVESIAEQMENPDLKNVGSSTGEKNERTSVAGTVRKCWPNRVAKEQISKRLDGNQYLFLPPNRYIFHGAEVYSDSEDDVLSSSSCGSNSDSGTCQSPSLEEPMEDESEIEEFYNGLEDEPDVPERAGGAGFGTDGDDQEAINEAISVKQEVTDMNYPSNKS

SEQ ID NO: 125 - DNA, 3793 bp, Mus musculus
  CDS (66)..(2162)
gccagtgccgcgcgtcgagcggagcagaggaggcgagggcggagggccagagaggcagttggaagatggcggacgaggtggcgctcgcccttcaggccgccggctccccttccgcggcggccgccatggaggccgcgtcgcagccggcggacgagccgctccgcaagaggccccgccgagacgggcctggcctcgggcgcagcccgggcgagccgagcgcagcagtggcgccggcggccgcggggtgtgaggcggcgagcgccgcggccccggcggcgctgtggcgggaggcggcaggggcggcggcgagcgcggagcgggaggccccggcgacggccgtggccggggacggagacaatgggtccggcctgcggcgggagccgagggcggctgacgacttcgacgacgacgagggcgaggaggaggacgaggcggcggcggcagcggcggcggcagcgatcggctaccgaggtccatatacttttgttcagcaacatctcatgattggcaccgatcctcgaacaattcttaaagatttattaccagaaacaattcctccacctgagctggatgatatgacgctgtggcagattgttattaatatcctttcagaaccaccaaagcggaaaaaaagaaaagatatcaatacaattgaagatgctgtgaagttactgcaggagtgtaaaaagataatagttctgactggagctggggtttctgtctcctgtgggattcctgacttcagatcaagagacggtatctatgctcgccttgcggtggacttcccagacctcccagaccctcaagccatgtttgatattgagtattttagaaaagacccaagaccattcttcaagtttgcaaaggaaatatatcccggacagttccagccgtctctgtgtcacaaattcatagctttgtcagataaggaaggaaaactacttcgaaattatactcaaaatatagataccttggagcaggttgcaggaatccaaaggatccttcagtgtcatggttcctttgcaacagcatcttgcctgatttgtaaatacaaagttgattgtgaagctgttcgtggagacatttttaatcaggtagttcctcggtgccctaggtgcccagctgatgagccacttgccatcatgaagccagagattgtcttctttggtgaaaacttaccagaacagtttcatagagccatgaagtatgacaaagatgaagttgacctcctcattgttattggatcttctctgaaagtgagaccagtagcactaattccaagttctataccccatgaagtgcctcaaatattaataaatagggaacctttgcctcatctacattttgatgtagagctccttggagactgcgatgttataattaatgagttgtgtcataggctaggtggtgaatatgccaaactttgttgtaaccctgtaaagctttcagaaattactgaaaaacctccacgcccacaaaaggaattggttcatttatcagagttgccaccaacacctcttcatatttcggaagactcaagttcacctgaaagaactgtaccacaagactcttctgtgattgctacacttgtagaccaagcaacaaacaacaatgttaatgatttagaagtatctgaatcaagttgtgtggaagaaaaaccacaagaagtacagactagtaggaatgttgagaacattaatgtggaaaatccagattttaaggctgttggttccagtactgcagacaaaaatgaaagaacttcagttgcagaaacagtgagaaaatgctggcctaatagacttgcaaaggagcagattagtaagcggcttgagggtaatcaatacctgtttgtaccaccaaatcgttacatattccacggtgctgaggtatactcagactctgaagatgacgtcttgtcctctagttcctgtggcagtaacagtgacagtggcacatgccagagtccaagtttagaagaacccttggaagatgaaagtgaaattgaagaattctacaatggcttggaagatgatacggagaggcccgaatgtgctggaggatctggatttggagctgatggaggggatcaagaggttgttaatgaagctatagctacaagacaggaattgacagatgtaaactatccatcagacaaatcataacactattgaagctgtccggattcaggaattgctccaccagcattgggaactttagcatgtcaaaaaatgaatgtttacttgtgaacttgaacaaggaaatctgaaagatgtattatttatagactggaaaatagattgtcttcttggataatttctaaagttccatcatttctgtttgtacttgtacattcaacactgttggttgacttcatcttcctttcaaggttcatttgtatgatacattcgtatgtatgtataattttgttttttgcctaatgagtttcaaccttttaaagttttcaaaagccattggaatgttaatgtaaagggaacagcttatctagaccaaagaatggtatttcacacttttttgtttgtaacattgaatagtttaaagccctcaatttctgttctgctgaacttttatttttaggacagttaactttttaaacactggcattttccaaaacttgtggcagctaactttttaaaatcacagatgacttgtaatgtgaggagtcagcaccgtgtctggagcactcaaaacttggtgctcagtgtgtgaagcgtacttactgcatcgtttttgtacttgctgcagacgtggtaatgtccaaacaggcccctgagactaatctgataaatgatttggaaatgtgtttcagttgttctagaaacaatagtgcctgtctatataggtccccttagtttgaatatttgccattgtttaattaaatacctatcactgtggtagagcctgcatagatcttcaccacaaatactgccaagatgtgaatatgcaaagcctttctgaatctaataatggtacttctactggggagagtgtaatattttggactgctgtttttccattaatgaggaaagcaataggcctcttaattaaagtcccaaagtcataagataaattgtagctcaaccagaaagtacactgttgcctgttgaggatttggtgtaatgtatcccaaggtgttagccttgtattatggagatgaatacagatccaatagtcaaatgaaactagttcttagttatttaaaagcttagcttgccttaaaactagggatcaattttctcaactgcagaaacttttagcctttcaaacagttcacacctcagaaagtcagtatttattttacagacttctttggaacattgcccccaaatttaaatattcatgtgggtttagtatttattacaaaaaaatgatttgaaatatagctgttctttatgcataaaatacccagttaggaccattactgccagaggagaaaagtattaagtagctcatttccctacctaaaagataactgaatttatttggctacactaaagaatgcagtatatttagttttccatttgcatgatgtgtttgtgctatagacaatattttaaattgaaaaatttgttttaaattatttttacagtgaagactgttttcagctctttttatattgtacatagacttttatgtaatctggcatatgttttgtagaccgtttaatgactggattatcttcctccaacttttgaaatacaaaaacagtgttttatacttgtatcttgttttaaagtcttatattaaaattgtcatttgacttttttcccgttaa

SEQ ID NO: 126 - protein, 698 aa, Mus musculus
MADEVALALQAAGSPSAAAAMEAASQPADEPLRKRPRRDGPGLGRSPGEPSAAVAPAAAGCEAASAAAPAALWREAAGAAASAEREAPATAVAGDGDNGSGLRREPRAADDFDDDEGEEEDEAAAAAAAAAIGYRGPYTFVQQHLMIGTDPRTILKDLLPETIPPPELDDMTLWQIVINILSEPPKRKKRKDINTIEDAVKLLQECKKIIVLTGAGVSVSCGIPDFRSRDGIYARLAVDFPDLPDPQAMFDIEYFRKDPRPFFKFAKEIYPGQFQPSLCHKFIALSDKEGKLLRNYTQNIDTLEQVAGIQRILQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRPQKELVHLSELPPTPLHISEDSSSPERTVPQDSSVIATLVDQATNNNVNDLEVSESSCVEEKPQEVQTSRNVENINVENPDFKAVGSSTADKNERTSVAETVRKCWPNRLAKEQISKRLEGNQYLFVPPNRYIFHGAEVYSDSEDDVLSSSSCGSNSDSGTCQSPSLEEPLEDESEIEEFYNGLEDDTERPECAGGSGFGADGGDQEVVNEAIATRQELTDVNYPSDKS

SEQ ID NO: 127 - DNA, 3910 bp, Mus musculus
  CDS (66)..(2279)
gccagtgccgcgcgtcgagcggagcagaggaggcgagggcggagggccagagaggcagttggaagatggcggacgaggtggcgctcgcccttcaggccgccggctccccttccgcggcggccgccatggaggccgcgtcgcagccggcggacgagccgctccgcaagaggccccgccgagacgggcctggcctcgggcgcagcccgggcgagccgagcgcagcagtggcgccggcggccgcggggtgtgaggcggcgagcgccgcggccccggcggcgctgtggcgggaggcggcaggggcggcggcgagcgcggagcgggaggccccggcgacggccgtggccggggacggagacaatgggtccggcctgcggcgggagccgagggcggctgacgacttcgacgacgacgagggcgaggaggaggacgaggcggcggcggcagcggcggcggcagcgatcggctaccgagacaacctcctgttgaccgatggactcctcactaatggctttcattcctgtgaaagtgatgacgatgacagaacgtcacacgccagctctagtgactggactccgcggccgcggataggtccatatacttttgttcagcaacatctcatgattggcaccgatcctcgaacaattcttaaagatttattaccagaaacaattcctccacctgagctggatgatatgacgctgtggcagattgttattaatatcctttcagaaccaccaaagcggaaaaaaagaaaagatatcaatacaattgaagatgctgtgaagttactgcaggagtgtaaaaagataatagttctgactggagctggggtttctgtctcctgtgggattcctgacttcagatcaagagacggtatctatgctcgccttgcggtggacttcccagacctcccagaccctcaagccatgtttgatattgagtattttagaaaagacccaagaccattcttcaagtttgcaaaggaaatatatcccggacagttccagccgtctctgtgtcacaaattcatagctttgtcagataaggaaggaaaactacttcgaaattatactcaaaatatagataccttggagcaggttgcaggaatccaaaggatccttcagtgtcatggttcctttgcaacagcatcttgcctgatttgtaaatacaaagttgattgtgaagctgttcgtggagacatttttaatcaggtagttcctcggtgccctaggtgcccagctgatgagccacttgccatcatgaagccagagattgtcttctttggtgaaaacttaccagaacagtttcatagagccatgaagtatgacaaagatgaagttgacctcctcattgttattggatcttctctgaaagtgagaccagtagcactaattccaagttctataccccatgaagtgcctcaaatattaataaatagggaacctttgcctcatctacattttgatgtagagctccttggagactgcgatgttataattaatgagttgtgtcataggctaggtggtgaatatgccaaactttgttgtaaccctgtaaagctttcagaaattactgaaaaacctccacgcccacaaaaggaattggttcatttatcagagttgccaccaacacctcttcatatttcggaagactcaagttcacctgaaagaactgtaccacaagactcttctgtgattgctacacttgtagaccaagcaacaaacaacaatgttaatgatttagaagtatctgaatcaagttgtgtggaagaaaaaccacaagaagtacagactagtaggaatgttgagaacattaatgtggaaaatccagattttaaggctgttggttccagtactgcagacaaaaatgaaagaacttcagttgcagaaacagtgagaaaatgctggcctaatagacttgcaaaggagcagattagtaagcggcttgagggtaatcaatacctgtttgtaccaccaaatcgttacatattccacggtgctgaggtatactcagactctgaagatgacgtcttgtcctctagttcctgtggcagtaacagtgacagtggcacatgccagagtccaagtttagaagaacccttggaagatgaaagtgaaattgaagaattctacaatggcttggaagatgatacggagaggcccgaatgtgctggaggatctggatttggagctgatggaggggatcaagaggttgttaatgaagctatagctacaagacaggaattgacagatgtaaactatccatcagacaaatcataacactattgaagctgtccggattcaggaattgctccaccagcattgggaactttagcatgtcaaaaaatgaatgtttacttgtgaacttgaacaaggaaatctgaaagatgtattatttatagactggaaaatagattgtcttcttggataatttctaaagttccatcatttctgtttgtacttgtacattcaacactgttggttgacttcatcttcctttcaaggttcatttgtatgatacattcgtatgtatgtataattttgttttttgcctaatgagtttcaaccttttaaagttttcaaaagccattggaatgttaatgtaaagggaacagcttatctagaccaaagaatggtatttcacacttttttgtttgtaacattgaatagtttaaagccctcaatttctgttctgctgaacttttatttttaggacagttaactttttaaacactggcattttccaaaacttgtggcagctaactttttaaaatcacagatgacttgtaatgtgaggagtcagcaccgtgtctggagcactcaaaacttggtgctcagtgtgtgaagcgtacttactgcatcgtttttgtacttgctgcagacgtggtaatgtccaaacaggcccctgagactaatctgataaatgatttggaaatgtgtttcagttgttctagaaacaatagtgcctgtctatataggtccccttagtttgaatatttgccattgtttaattaaatacctatcactgtggtagagcctgcatagatcttcaccacaaatactgccaagatgtgaatatgcaaagcctttctgaatctaataatggtacttctactggggagagtgtaatattttggactgctgtttttccattaatgaggaaagcaataggcctcttaattaaagtcccaaagtcataagataaattgtagctcaaccagaaagtacactgttgcctgttgaggatttggtgtaatgtatcccaaggtgttagccttgtattatggagatgaatacagatccaatagtcaaatgaaactagttcttagttatttaaaagcttagcttgccttaaaactagggatcaattttctcaactgcagaaacttttagcctttcaaacagttcacacctcagaaagtcagtatttattttacagacttctttggaacattgcccccaaatttaaatattcatgtgggtttagtatttattacaaaaaaatgatttgaaatatagctgttctttatgcataaaatacccagttaggaccattactgccagaggagaaaagtattaagtagctcatttccctacctaaaagataactgaatttatttggctacactaaagaatgcagtatatttagttttccatttgcatgatgtgtttgtgctatagacaatattttaaattgaaaaatttgttttaaattatttttacagtgaagactgttttcagctctttttatattgtacatagacttttatgtaatctggcatatgttttgtagaccgtttaatgactggattatcttcctccaacttttgaaatacaaaaacagtgttttatacttgtatcttgttttaaagtcttatattaaaattgtcatttgacttttttcccgttaa

SEQ ID NO: 128 - protein, 737 aa, Mus musculus
MADEVALALQAAGSPSAAAAMEAASQPADEPLRKRPRRDGPGLGRSPGEPSAAVAPAAAGCEAASAAAPAALWREAAGAAASAEREAPATAVAGDGDNGSGLRREPRAADDFDDDEGEEEDEAAAAAAAAAIGYRDNLLLTDGLLTNGFHSCESDDDDRTSHASSSDWTPRPRIGPYTFVQQHLMIGTDPRTILKDLLPETIPPPELDDMTLWQIVINILSEPPKRKKRKDINTIEDAVKLLQECKKIIVLTGAGVSVSCGIPDFRSRDGIYARLAVDFPDLPDPQAMFDIEYFRKDPRPFFKFAKEIYPGQFQPSLCHKFIALSDKEGKLLRNYTQNIDTLEQVAGIQRILQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRPQKELVHLSELPPTPLHISEDSSSPERTVPQDSSVIATLVDQATNNNVNDLEVSESSCVEEKPQEVQTSRNVENINVENPDFKAVGSSTADKNERTSVAETVRKCWPNRLAKEQISKRLEGNQYLFVPPNRYIFHGAEVYSDSEDDVLSSSSCGSNSDSGTCQSPSLEEPLEDESEIEEFYNGLEDDTERPECAGGSGFGADGGDQEVVNEAIATRQELTDVNYPSDKS

SEQ ID NO: 129 - DNA, 3698 bp, Rattus norvegicus
  CDS (446)..(2113)
cacagattttatttttgtgttgtgtgccttcgttttggattttgaggtagggtccccgtttagcccaggctggtcctggaactattttgtaaggtcaggctggtttacaacgtctgtgccttccagttgctggaattacagatgtgtgtgggtctatgcctttctgggttttgtttttgtctcaaaaacttgtgtctcactgtataagccaaaccggcctcaaagtacctgggattgcaggtatggacagcaagcagctggggattgtctgagcagcagctttttgatctctttgacagacaacctcctgttggctgatgagatcatcactaatggctttcattcctgtgaaagtgatgacgatgacagagcatcacacgcaagctctagtgactggactccaaggccacggataggtccatatacttttgttcagcaacacctcatgattggcaccgatcctcgaacaattcttaaagatttattaccagaaacaattcctccacctgagttggatgatatgacactgtggcagattgttattaatatcctttcagaaccaccaaagcggaaaaaaagaaaagatattaatacaattgaagatgctgtgaagttactacaagagtgcaaaaagataatagttctgactggagctggggtttctgtttcctgtgggatacctgacttcagatcaagagatggtatttatgctcgccttgctgtggacttcccggatctcccagatcctcaagccatgttcgatattgagtattttagaaaagacccaagaccattcttcaagtttgcaaaggaaatatatcccggacagttccagccatctctgtgtcacaaattcatagctttgtcagataaggaaggaaaactacttcgaaattatactcaaaatatagataccttggagcaggttgcaggaatccaaaggatcattcagtgtcatggttcctttgcaacagcatcttgcctgatttgtaaatacaaagttgattgtgaagctgttcgtggagatatttttaatcaggtagttcctcggtgtcctaggtgcccagctgatgagccacttgccatcatgaagccagagattgtcttctttggtgaaaacttaccagaacagtttcatagagccatgaagtatgacaaagatgaagttgacctcctcattgttattgggtcttctctgaaagtaagaccagtagcactaattccaagttctataccccatgaagtgcctcaaatattaataaatagggaacctctgcctcatctacattttgatgtagagcttcttggagactgcgatgtcataattaatgagttgtgtcataggttaggtggcgagtatgccaaactttgttgtaaccctgtaaagctttcagaaattactgaaaaacctccacgaacacaaaaggaattggttcatttatcagagttgccaccaacacctcttcatatttcagaagactcaagttcacctgaaagaactgtaccacaagactcttctgtgattgctacacttgtagaccaaacaataaagaacaaagttgacgatttagaagtatctgaaccaaaaagttgtgtggaagaaaaatcacaggaagtacagacttataggaatgttgagagcattaatgtggaaaacccagatttcaaggctgttggttccagtactggagacaaaaatgaaagaacttctgttgcagaaacagtgagaaaatgctggcctaatagacttgcaaaggagcagattagtaagcgtcttgacggtaatcaatacttgtttgtaccaccaaatcgttacatatttcatggtgctgaggtatactcagactctgaagatgacgccttatcctctagttcctgtggcagtaacagtgacagtggcacatgccagagtccaagtttagaagaacccttggaagatgaaagtgaaattgaagagttctacaatggcttggaagatgatgctgacagaccggagtgtgctggaggatctggagctgacggaggggatcaagaggcagttaatgaagctatagccatgaaacaggaattaacagatgtaaactgtacaccagacaaatcagagcactattgaagctgtccaggtacaggaattgctccaccagcattgggaactttagcatgtcaaaaatgaatgtttactgtgaacttgaacaaggagatcagaaagatgtattatttatagactggaaaatagattgtcttcttggataatttttaaagttccatcatttctgtactttaatcagctgttggctgacttcatcttcctttcaaggttcatttgtatgatacattcgtatgtatataatttcttcgtttttgcctaattgagtttcaacattttaaagttttcaaaagccattggaatgttaatgtaaagggaacagcttatctagaccaaagaatggtatttcacacttttgtttgtaacattgaatagtttgaaaccctcaatttctgttctgctgaacttttatttttagcacagttaactttttaaacactggcattttccaaaatttatggcagctaactttttaaaatcacaaatgacttgtaatgtgagaaggaagtcagcatcgcattgggagctcagagtttgagcatatttattgcatggttttttgtacttgctgcagacgtggtaatgtccaaacaggcccctgagactaatctgataaatgatttggaaatgtttcagttcttctagaaactattgtgcctgtctatataggtccccttagtttgaatatttgccattgtttaattaaatacctatcactgtggtagagcctccatagatcttcaccacaaatactgccaagatgtgaatttgaatatgcaaagcctttctgaccctaatgatggtacttctactggggagagtgtaatattttggactgctgtttttccattaacaaggaagcaaaggtctcttaattaaagttccaaagtaataagattaattgtaactcaaccagaaagtacattgtctcctgttgaggatttggtgtaatgtatcccaagggatgtgtattatggagatgaatacaaatccaatagtcaatgaaactagttcctatttatttaaaagcttagcttgccttaaaactagggatcaattttctgaactgcagaaacttttagcctttcaaacagttcacacctcagaaggtcagtattttacagacttctttggaacattgcccccaaatttaaatattcacgttggtttagtatttattacaaaaaaatgatttgaaatatagctgttctttatgcataaaatacccagctaggaccgttactgccagaggataaagtattaagtagctcatttccctacctaaaatattctcaatctgaatttatttggctacactaaagaatgcagtatatttagttttccatttgcatgatgtgtttgtgctatagacaatattttaaattgaaaaatttgttttaaattatttttacagtgaagactgttttcagctctttttatattgtacatagacttttatgtaatctggcatatgttttgtagaccgtttaatgactggattatcttcctccaacttttgaaatacaaaaacagtgttttatacttgtatcttgttttaaagtcttatattaaaattgtcatttgacttttt

SEQ ID NO: 130 - protein, 555 aa, Rattus norvegicus
MIGTDPRTILKDLLPETIPPPELDDMTLWQIVINILSEPPKRKKRKDINTIEDAVKLLQECKKIIVLTGAGVSVSCGIPDFRSRDGIYARLAVDFPDLPDPQAMFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELVHLSELPPTPLHISEDSSSPERTVPQDSSVIATLVDQTIKNKVDDLEVSEPKSCVEEKSQEVQTYRNVESINVENPDFKAVGSSTGDKNERTSVAETVRKCWPNRLAKEQISKRLDGNQYLFVPPNRYIFHGAEVYSDSEDDALSSSSCGSNSDSGTCQSPSLEEPLEDESEIEEFYNGLEDDADRPECAGGSGADGGDQEAVNEAIAMKQELTDVNCTPDKSEHY

SEQ ID NO: 131 - DNA, 4024 bp, Sus scrofa
  CDS (16)..(2244)
agaggcagttgaaagatggcggacgaggcggcgctcgcccttcagcccggcggctccccctcggcggtggcggctgagagggaggccccgtcgccccccgccggggagccgctccgcaagaaaccgcggagagacggcccgggcgtcgggcggagcccgggcgagcctggtggggcggccttggagcgtgagctgccggcggcggcgggcggctgcccggcggcggcggtgctgtggcgggagaccgctgcgggcggggagcgggaggcccaggcggctgcggcggcaggagaaggaaacaatgggccgggcttacagggcctatcccgggaggcgcccccggccgacgacttctacgacgacgacgacgacgacgagggcgaggaggaggaagaggcggcggcagcggcggctattgggtaccgagataaccttctgtttggtgatgaaatcgtcaccaatggtttccattcttgtgaaagtgatgaggatgatagagcctcacatgccagttctagtgactggactccaagaccacggataggtccatatacttttgttcagcaacatctcatgattggcacagatcctcgaacaattcttaaagatttgctaccagaaacaattcctccacctgaattggatgatatgacactgtggcagattgttattaatatcctttcagaaccaccaaaaaggaaaaaaagaaaagatattaatacaattgaagatgctgtgaaattactacaagagtgcaaaaaaataatagttctaactggagctggggtttctgtttcttgtggaatacctgacttcaggtcaagagatggcatttatgcacgccttgcagtagactttccagaccttcctgatcctcaagcaatgtttgatattgaatatttcagaaaagatccaagaccattcttcaagtttgcaaaggaaatatatcctggacagttccagccatctctctgtcacaaattcatagccttgtcagataaggaaggaaaactgcttcgcaactatactcagaacatagatacactggaacaggttgcaggaatccagaggataatccagtgtcatggttcctttgcaacagcatcttgcctgatttgtaaatataaagttgactgtgaagctgtacgaggagatatttttaatcaggtggttcctcgatgtcctaggtgcccagctgatgaaccacttgctatcatgaaaccagagattgtcttttttggtgaaaatttaccagagcagtttcatagagccatgaagtatgacaaagatgaagttgatcttctcattgttattgggtcttccctgaaagtaagaccagtagcactaattccaagttccataccccatgaagtgcctcagatattaattaatagggaacctttgcctcacctgcattttgatgtagagcttcttggagactgtgatgtcattattaatgaattgtgtcataggttaggaggtgaatatgccaagctttgctgcaaccctgtaaagctttcagaaattactgaaaagcctccacgaacacaaaaagagttggctcacttgtcagagttaccacccacacctcttaatatttcagaaggctctagttcaccagaaagaacttcaccaccagcttcttcagtgactctccctcttttagaccaagcaacaaagagtaatgttgatgatctagatgtgtctgagtcaaaagactgtgttgaagagaaatcacaggaagtacagacttctaggagcattgaaagtgttaaagaaccgatggagagtccaggtttgaagaatgttgcctgcagtaatggagagaaaaatgaaagaacttcagttgccgaaacagtaagaaaatgctggccagctagacttgcaaaggagcagattagtaaacggcttgatggtaatcagtatctgtttttaccaccaaaccgttatattttccatggcgctgaggtatattcagactctgaagatgatgtcttatcctctagttcttgtggcagtaacagtgagagtggaacttgccagagtccaagtctagaagaacccatggaggatgaaagtgagattgaagaattttacaatggtttggaagatgatgctgatgttaatatgcgagctggaggaactggatttggagctgatggaagtgaccaagaggcagttaatgaagctatatccatgaaacaggaagcaacaggcgttaactatccatcaaacaaatcataatgtaataattgtccaggtacaggaattgttccaccagcattagggactttagcatgtcaaattgaacatttacttgtgaacctagtagcgcaaggaaaccagaaaggtgtaatatttataaactggtaaaagattttcttcccatgggtaatttttaacttcttgtttctgtgcttatatactcaaacactaactttttttttttttttttaaagaaaggtactaagtatctttaatcagctgttggacaagactttattttaaagattcatttgtatgatatatccccatgtatatataatttttttttttttgcctagtgagtttcaacattttaaagttttcaaaaagccattggaatgttaaattaatgtaaagggaacagcttatctagaccaaagaatggtactttcacacttttctttgtaacattgaatggtttaaaatcctcaaatctgtctgctgaacttttgattctttattagcacaattacctatttttaaacactggcatttttccaaaacttgtggcagctaactttttaaaaatctcatgacatgcagtgtgagtagaaagaagtcaacggtatgtgggagagcacttagttgtctttgctttttaaagtgagacttggtgctaatcgtttcaggaatattgtattgttcaaatgaagatggcttttgtacttcctgtggacatgtggtaatgtctatattgcctcataaaactaacctaaaaaacaaataaatgctttggaaatgtttcagttgctttagaaacagtagtgcctgccttggtccccttagttataagaatatttgctattgtttaaatacctatcactgtggtagagcttgcattgatccttttccacaagtattaaactgccaagatgtgaatttgcaaagtctttatgaaccaataataacggtacttcaacttggggagcgtgtaataatttggactgttgctcccccttacccctgcaccccccattaagtgagagcaacaggccctgatttaggttccaaagccagtaagtacatgtttcctgttgggaagatttggtgtaataaacaccaaactattagacggagacgaaggcgatgtgacttgtaataccagaatagctgatgaaactagttcctataaaaagcttagcctgccttaaaactagacatcaattttctcagctgcagaagcttctagcctttcaaaaaagttcatactttataaagttgcagagaagcatttattttccagtcctttccccaatgttacttccaaataaagtattcctatgttgctttagtatttattacaatttaacaaaaaagggtttgaaatgtagctgttctttaagtataaaatacccagcttggaccattactgccggagaagagttttattgaatggctatttccctacctaaaagaggtctcaaactgaatttattgggctacgctaaagaatgcagtatatttagttttccatttgcatgatgtgtgtttgtgctatagatgatattttaaattgaagaatttgttttaaattatttttacagtgaagactgttttcagctctttttatattgtacatagtcttttatgtaatctactggcatatgttttgtagactgtttaatgactggatatcttcctccaacttttgaaatacaaaaccagtgttttatacttgtacactgttttaaagtctattaaaattgacatttgacaaaaaaaaaaaacctatagtgaaatcactagtggaggatccgct

SEQ ID NO: 132 - protein, 742 aa, Sus scrofa
MADEAALALQPGGSPSAVAAEREAPSPPAGEPLRKKPRRDGPGVGRSPGEPGGAALERELPAAAGGCPAAAVLWRETAAGGEREAQAAAAAGEGNNGPGLQGLSREAPPADDFYDDDDDDEGEEEEEAAAAAAIGYRDNLLFGDEIVTNGFHSCESDEDDRASHASSSDWTPRPRIGPYTFVQQHLMIGTDPRTILKDLLPETIPPPELDDMTLWQIVINILSEPPKRKKRKDINTIEDAVKLLQECKKIIVLTGAGVSVSCGIPDFRSRDGIYARLAVDFPDLPDPQAMFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAHLSELPPTPLNISEGSSSPERTSPPASSVTLPLLDQATKSNVDDLDVSESKDCVEEKSQEVQTSRSIESVKEPMESPGLKNVACSNGEKNERTSVAETVRKCWPARLAKEQISKRLDGNQYLFLPPNRYIFHGAEVYSDSEDDVLSSSSCGSNSESGTCQSPSLEEPMEDESEIEEFYNGLEDDADVNMRAGGTGFGADGSDQEAVNEAISMKQEATGVNYPSNKS

SEQ ID NO: 133 - DNA, 3959 bp, Bos taurus
  CDS (34)..(2238)
gcgagggaggagggccagagaggcggttgaaagatggcggacgaggcggcgctcgcccttcagcccggcggctctccctcggtagtggcggctgagagggaggccccgtcgccgcctgctggggagccgctccgcaagaggccgcgaagagacggccccggcgtcgggcggagctcgggcgagcccggtgggacggcccccgagcgggaactgccggcggcggccggcagttgcccggcggcggcggcggcgctgtggcgggaggcccaggcggcggcggcggcggcggccgaagaagaagacaatgggccgggcttacagggcctatccagggaggcgccaccggccgacgacttctacgacgacgacgacgagggcgaggaggaggaagaggcggcggccgctattgggtaccgagataaccttctgtttggtgatgaaatcatcaccaacggtttccattcgtgtgaaagtgacgaagatgatagagcctcgcatgcgagttctagtgactggactccaagacctcggataggtccatatacttttgttcagcaacatctcatgattggcacagatcctcgaacaattcttaaagatttactaccagaaacaattcctccacctgaattggatgatatgacactgtggcagattgttattaatatcctttcagaaccaccaaaaaggaaaaaaagaaaagatattaatacaattgaagatgctgtgaaattactgcaagagtgcaaaaaaataatagttctaactggagctggggtttctgtttcttgtggaatacctgacttcaggtcaagagacggtatttatgctcgccttgcaatagactttccagaccttccagatcctcaagcaatgtttgatattgaatatttcagaaaagacccaagaccattcttcaagtttgcaaaggaaatatatcctggacaattccaaccatctctttgtcacaaattcatagccttgtctgataaggaaggaaaactacttcgcaactatactcagaacatagatacactggagcaggttgcaggaatccaaaagataattcagtgtcatggttcctttgcaacagcatcttgcctgatttgtaaatataaagttgactgtgaagctgtacgaggagatatttttaatcaggtggttcctcgatgtcctagatgcccagctgatgaaccgcttgctatcatgaaaccagaaattgtcttttttggtgaaaatttaccagaacagtttcatagagccatgaagtatgacaaagatgaagttgatcttctcattgttattggatcttccctgaaagtaagaccagtagcactaattccaagttccataccccatgaagtgcctcagatattaattaatagggaacctttgcctcacctgcattttgatgtagagcttcttggagactgtgacgtaattattaatgaactgtgtcataggttaggtggtgaatatgccaaactttgctgtaaccctgtgaagctttcagaaattactgaaaaacctcctcgaatacaaaaagagttggcacatttgtcagaattgccacccacacccctcaatatttcagaaggctcaagttcaccagaaagaacttcaccaccagattcttcagtgattgtcactcttttagaccaagaaacaaagagtaacgttgatgatccagatgtgtctgaatcaaaagaccatgtcacagaaaaatcacaggaagtacagacttctactaggagcattgaaagtgttaatgaacagttggagagtccagatttgaagaatgctgtctccaattctggtgagaaaaatgaaagaacttcagtagctgaaacagtgagaaaatgctggccagctagacttgcaaaggagcagattagtaaacgccttgatgataatcagtatctgtttttaccaccaaaccgttacattttccatggcgctgaggtatattcagactctgaagatgatgtcttatcctctagttcttgcggcagtaacagtgatagtggaacgtgccagagtccaagtttagaagaacccatggaggatgaaagtgagaatgaagaattttacaatggtttggaagatgatgctgatgttaatgagagagctggaggaactgtatttgaagctgatggaggtgatcaagaggcaattaatgaagctatatctgtgaaacaggaagcaacatgcattaactatccatcaaacaaatcataatatagtaattgtccaggtacagaaattgttccaccagcattagaatctttagcatgtcaaattgaatgtttacttgtgaactcaatagagcaaggaaaccagaaaggtataatatttatagactggtatcccctcaatgggtaatttttaacttccttatttctgtgcttatacactcaaacactaactttttttttttaaacaaaggtacgtaagtatctttagtcagctattggactagactttctgttaaaggttcatttgtatgatacatcgacatgtatatataattgtttttgcctagtgagtttcaacatttcagagtcttcaaaaagccattggaatgttaaattaatgtaaagggaacagcttatctagaccaaagaatggtattttcacacttttcgttttaacattgaatggtttgaaatcctcaaatctgttctgctaaacgtttgattctttattagcacaattacctatttttaaacactggcattttccaaaacttgtggcagctaactttttaaaaatctcatgacatgcaatgtgagaaggaagtcaacgacgtgggagagcactcagttgtttttgcttttttaaaatgaaacttggtgctaacagtttcagaaatgtatcgttcaaatgaagatcgcttttgtacttcctgtggacatgtagtaatgtctatattggctcataaaactaacttaaaaaataaatgctttggaaatgtttcagttgctttagaaacaatagtacctgcctgggtccccttagttttaagaatatttgccattgttgtttaaacacctatcactgtggtagagcttgcattgatcctttccacaagtattaaactgccaatgtcaatctgcaaagcctttatgatcaataataatggtactttaactggggagagtgtaatattttggactgttgccttttttgcccattcatgagagcagcagacccagattacggttccaaagccagaaagtacatgtttcctgttgggaggacttggtgtaagaaacaccaaacatactagcctagtattatggagatgaacgtgatgtaacttgtaatagcagaatagttaatgaaactagttcctataatgtctttatttaaaagcttagcctgccttaaaactagagaacaactttttcagctgcagaagcttctagcctttcaacaaaagtttgtactttataaaattgcacagtaacgatttatttctcagacctttccccaacattgttttcaaaaagtatttttatgttgctttagtatttattacagtttaacaagaagggtttgaaaaacagctgttcttaagcttaaaatatccagctaggaccattactgccagaggaaaaaattttattgaatggccatttccctacctaaaagatgtttcaatctgaatttatttgactacactaaagaatacagtatatttagttttccatttgcatgatctgtgtttgtgctatagatgatattttaaattgaaaaatttgttttaaattatttttacagtgaagactgttttcagctctttttatattgtacatagtcttttatgtaatctactggcatatgttttgtagactgtttaatgactggatatcttcctcaaacttttgaaatacaaaaccagtgttttatacttgtacactgttttaaaagtctattaaaattgtcatttgactttt

SEQ ID NO: 134 - protein, 734 aa, Bos taurus
MADEAALALQPGGSPSVVAAEREAPSPPAGEPLRKRPRRDGPGVGRSSGEPGGTAPERELPAAAGSCPAAAAALWREAQAAAAAAAEEEDNGPGLQGLSREAPPADDFYDDDDEGEEEEEAAAAIGYRDNLLFGDEIITNGFHSCESDEDDRASHASSSDWTPRPRIGPYTFVQQHLMIGTDPRTILKDLLPETIPPPELDDMTLWQIVINILSEPPKRKKRKDINTIEDAVKLLQECKKIIVLTGAGVSVSCGIPDFRSRDGIYARLAIDFPDLPDPQAMFDIEYFRKDPRPFFKFAKEIYPGQFQPSLCHKFIALSDKEGKLLRNYTQNIDTLEQVAGIQKIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRIQKELAHLSELPPTPLNISEGSSSPERTSPPDSSVIVTLLDQETKSNVDDPDVSESKDHVTEKSQEVQTSTRSIESVNEQLESPDLKNAVSNSGEKNERTSVAETVRKCWPARLAKEQISKRLDDNQYLFLPPNRYIFHGAEVYSDSEDDVLSSSSCGSNSDSGTCQSPSLEEPMEDESENEEFYNGLEDDADVNERAGGTVFEADGGDQEAINEAISVKQEATCINYPSNKS

SEQ ID NO: 135 - DNA, 4111 bp, Felis catus
  CDS (64)..(2304)
agtgccgcgagtcgagcgggagcagaggaggcgagggaggagggccagagaggcagttggaagatggcggacgaggcggcgctcgcccttcagcccggcggctccccctcggcggtggtggccgagagggaggccgcgtcgccgcccgccggagagccactccgcaagaggccgcggagagactgtccaggcctggggcggagcccgggcgagcccggtggggcggcccccgagcgtgaagtgccggcggcgaccggaggctgccccgcggcggccgcggcgctgtggcgggaggcggcagcggcgggcgaggagcgggaggcccaggcggcgacggccggagaaggagacaatgggccgggcctacagggcctaacccgggagccgccgccggccgacgacttctacgacgacgacgacgacgacgacgacgagggcgaagaggaggaagaggcggcggcggcggcggcgattgggtaccgagataaccttctgtttggtgatgaaataatcaccaatggttttcattcctgtgaaagtgatgaggatgatagagcctcgcatgcaagttctagtgactggactccaaggccacgtataggtccatatacttttgttcagcaacatctcatgattggcacagatcctcgaacaattcttaaagatttattaccagaaacaattcctccacctgaattggatgatatgacactgtggcagattgttattaatatcctttcagagccaccaaaaaggaaaaaaagaaaagatattaatacaattgaagatgctgtgaaattattacaagagtgcaaaaaaataatagttctaactggagctggggtttctgtttcttgtggaatacctgacttcaggtcaagagatggtatttatgctcgccttgcaatagacttcccagaccttccagaccctcaagcaatgttcgatattgaatatttcagaaaagatccaagacctttcttcaagtttgcaaaggaaatatatcccggacagttccaaccatctctctgtcacaaattcatagccttgtcagataaggaaggaaaactgcttcggaactatactcagaacatagatacactggaacaggttgcaggaatccaaaggataattcagtgtcatggttcctttgcaacagcctcttgcttgatttgtaaatacaaagtagactgtgaagctgtacgaggagatatttttaatcaggtggttcctcgttgtcctaggtgcccagctgatgaaccacttgctatcatgaagccagagattgtcttttttggtgaaaatttaccagagcagtttcatagagccatgaagtatgacaaagatgaagttgatctccttattgttattgggtcttccctgaaagtaagaccagtagcactaattccaagttccataccccatgaagtgcctcagatactaataaatagagaacctttgcctcatctgcattttgatgtagagcttcttggagactgtgatgtcataattaatgaattatgtcataggttaggtggtgaatatgccaaactttgctgcaaccctgtaaagctttcagaaattactgaaaaacctccacgaacacaaaaagagttggctcatttgtcagagttgccacccacacctcttaatatttcagaagactcaagttcaccggaaagaacttcaccaccagattcttcagtgattgttacacttttagaccaagcaactaagagcaatgttaatgatcctgaggtgtctgaaccaagagatcatatggaagaaaaatcacaggaaggacagaattctactaggaacattgaaagtgttactgaacagctgggaagtccagattcgaagaatgttgactctaatactggggaaaaaaatgaaagaacttcaattgctgaaacagtgaggaagtgctggccagctcgacttgcaaaggagcagattagcaaacggcttgatggtaatcagtatctgtttttaccaccaaatcgttatattttccatggcgctgaggtatattcagactctgaagatgacgtgttatcctctagttcttgtggcagtaacagtgatagtggaacatgccagagtccaagtttagaagaacacttggaggatgaaagtgagattgaagaattttacaacggtttggaagacgatgctgatgttaatgagagagctggaggaactggatttggagttgatggaggtgatcaagaggcagttaatgaagctatatccgtgaaacaggaagcaacagacattaactatccatcaaacaaatcataatgtaatagttgtccaggtacaggaattgttccaccagcattaggaactttagcatgtcaaaaggaatgtttacttgtgaattcaacagagcaaggaaaccagaaaggtgtaatatttatagactggtaaaataagattttttcttcatgggtaatttttaacttcttatttctgtacttgtacatgcaacactaactttttttaaaagaagggtactaagtatctttaatcacctgttggtcaagacttttcttttaaaagttcatttgtatgatacatccgttatgtatatataattttgttcttgcctagtgagtttcaacattttaaagttttcaaaaagccattggaatgttaaattaatgtaaagggaacagcttatctagaccaaagaatggtattttcacacttttatttgtaacattgaatagtctgaactcctcaaatgtctgttctgctaaacttttggttctttattagcacaattacctatttttaaacactggcattttccaaaacttgtggcagctaactttttaaaaatctcataacatgcagtgtgtgtagaaagaagtcaacaatatgtgggagagcactcagttgtctttgctttttaaagtaagacttggtgctaagaatttcaggaatattgtattgttgaaatgaagatggcttttgtacttcctgtggacatgtagtaatgtctatattggctcctaaaactaatctgaaaaacaaataaatgctttggaaatgtttcaattgctttagagacaatagtgcctgcctgggtacccttagtttcaagaatatttgccattgttgtttaaatacatatcactgtggtagagcttgcattgattctttcccccaagtattaaactgccgagatgtgaatatgcagagcccttatgaatctataataatggtacttcaactgggaagagtgtaatattttggactgctgcttttcttttccactaatgaggagagcaacaggcccctgattacagttccaaagtactaagatgttaattataactcagccagtaagtacatgtctcctgttgggaggatttggtgtaatagacaccaaactgctagcctagtattatggagatgaacatgatgtaacttgtaatagcagaatagttaatgaagttagttcctgtaacatctttatttaaaagcttagcctgccttaaaactagagatcaaacttttctcagctgcagaagcttctagcctttcaaaaaattcatactttataaaattgcacagagcaatttattttccagaccttgcccccacattatttccaaatataaagtattcctatgttgctttagtatttattacaattttaaaaaaggtttgaaatatagctgttctttaagcataaaatacccagctaggaccattactgccagggagagaaattttattgaatggccatttccctacctaaaagatgtttcagtttgaatttatttggctacactaaagaatgcagtatatttagttttccatttgcatgatgtgtgtttgtgctatagatgatattttaaattgaaaaatttgttttaaattatttttacagtgaagactgttttcagctctttttatattgtacatagtcttttatgtaatctactggcatatgttttgtagactgttgaatgactggatatcttcctccaacttttgaaatacaaaaccagtgttttatacttgtacactgttttaaagtctattaaaattgtcatttgactttttcctgcaaaaaaaaaaaaaaaaaaaaaaaaaa

SEQ ID NO: 136 - protein, 746 aa, Felis catus
MADEAALALQPGGSPSAVVAEREAASPPAGEPLRKRPRRDCPGLGRSPGEPGGAAPEREVPAATGGCPAAAAALWREAAAAGEEREAQAATAGEGDNGPGLQGLTREPPPADDFYDDDDDDDDEGEEEEEAAAAAAIGYRDNLLFGDEIITNGFHSCESDEDDRASHASSSDWTPRPRIGPYTFVQQHLMIGTDPRTILKDLLPETIPPPELDDMTLWQIVINILSEPPKRKKRKDINTIEDAVKLLQECKKIIVLTGAGVSVSCGIPDFRSRDGIYARLAIDFPDLPDPQAMFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAHLSELPPTPLNISEDSSSPERTSPPDSSVIVTLLDQATKSNVNDPEVSEPRDHMEEKSQEGQNSTRNIESVTEQLGSPDSKNVDSNTGEKNERTSIAETVRKCWPARLAKEQISKRLDGNQYLFLPPNRYIFHGAEVYSDSEDDVLSSSSCGSNSDSGTCQSPSLEEHLEDESEIEEFYNGLEDDADVNERAGGTGFGVDGGDQEAVNEAISVKQEATDINYPSNKS

SEQ ID NO: 137 - DNA, 4128 bp, Canis familiaris
  CDS (104)..(2341)
cggggtttaaatctcccgcagccggagccgcgggggcgccagtgccgcgagtcgagcgggagcagaggaggcgagggaggagggccagagaggcagttggaagatggcggacgaggcggcgctcgcccttcagcccggcggctccccctcggcggtggcggccgagagggaggccgcgtcgccgcccgccggggagccactccgcaagaggccgcggagagactgtcctggcctggggcggagcccaggcgagcccggcggggcggcccctgagcgggaggtgccggcggcgaccgggggctgctccgcggcggccgcggcgctgtggcgggaggcggcggcgggcggggagcgggaggcccaggcggcggtggcggcggccggagaaggagacaatgggccgggcctacagggcctaacgcgcgagccgctgccggctgacgactttgttgacgacgacgatgacgacgagggcgaagaggaggaagaggcggcggcggcgtcggcgattgggtaccgagataaccttctgtttgatgatgaaataatcaccaacggttttcattcctgtgaaagtgatgaggatgatagagcctcacatgcaagctctagtgactggactccaaggccccggataggtccatatacttttgttcagcaacatctcatgattggcacagatccacgaacaattcttaaagatttactaccagaaacaattcctccacctgaattggatgatatgacactgtggcagattgttattaatatcctttcagaaccaccaaaaaggaagaaaagaaaagatattaatacaattgaagatgctgtgaaattactgcaagagtgcaaaaaaataatagttctaactggagctggggtttctgtttcttgtggaatacctgacttcaggtcaagagatggtatttatgctcgccttgcaatagacttcccagaccttccagatcctcaagcaatgtttgacattgaatatttcagaaaggatccaagaccattcttcaagtttgcaaaggaaatctatcccggacagttccaaccatctctctgtcacaaattcatagccttgtcagataaggaaggaaaactacttcggaactatactcagaacatagatacactggaacaggttgcaggaatccaaaggataattcagtgtcatggttcctttgcaacagcatcttgcctgatttgtaaatacaaagtagactgtgaagctgtacgaggagatatttttaatcaggtggttcctcgttgtcctaggtgcccagctgatgagccacttgctatcatgaaaccagagattgtcttttttggtgaaaatttaccagagcagtttcatagagccatgaagtatgacaaagacgaagttgatctcctcattgtaattgggtcttccctgaaagtaagaccagtagcactaattccaagttccataccccatgaagtgcctcagatattaataaatagagaacctttgcctcatctgcattttgatgtagagcttcttggagactgtgatgtcataataaatgaattatgtcataggttaggtggtgaatatgccaaactttgctgcaaccctgtaaagctttcagaaatcactgaaaagcctccacgaacacaaaaagagttggctcatttgtcagagttgccacccacacctcttaatatttcagaagactccagttcaccggaaagaacttcaccaccagattcttcagtgattgttacgcttttagacgaagcaactaagagtaatgttgatgatcccggtgtgtccgaatcaagagattgtatggaagaaaaatcacaggaaggacagaattctattaggaacattgaaagtgtcactgaacatctggaaagtccggatttgaagaatgttggctgtaatactggggagaaaaatgaaagaacttcagttgctgacccggtgaggaagtgctggccagctagacttgcaaaggagcagattagcaaacggcttgatggtaaccagtatctctttttaccaccaaatcgttacattttccatggcgctgaggtatattcagactctgaagatgacgtcttatcctctagttcttgtggcagtaacagtgatagtggaacctgccagagtccaagtttagaagaacacttggaggatgaaagtgagattgaagaattttacaatggtttggaagatgaagctgatgtcaatgagagagctggaggaactggatttggaattgatggaggtgatcaagaggcagtcaatgaagctatatccatgaaacaggaagcaacagatactaactatccatcaaacaaatcataatgtagtaattgtccaggtacaggaattgttccaccagcattaggaatttcagcatgtcaaaatgaatgtttacttgtgaattcaacagagcaaggaaaccagaaaggtgtaatatttatagactggtaaattagattgttttttcatggataatttttaacttcttatttctgtacttgtacactcaacactaactttttttaaaagaagggtactaagtatctttaatcacatgttggtcaagacttttcttttaaaggttcatttgtatgatacatccatatgtatatataattttgttcttgcctagtgaatttcaacattttaaagttttcaaaaagccattggaatgttaaattaatgtaaagggaacagcttatctagaccaaagaatggtattttcacacttttctttgtaacattgaatggtttgaactccttaaatgtctgttctgctaaacttttgattctttattagcacacaattacctatttttaaacactggcattttccaaaacttgtggcagctaactttttaaaaatttcatgacatgcagtatgtatagagggaagtcaacaatatgtgggagagcacttagttgtccttgctttttaaagtaagacttggtgctaagagtttcaggaatactgtattgttgaagatggcttttgtacttcctgtggacatgtagtaatgtctatattggctcctaaaactaagctgaaaaaaaataaatgctttggaaatgtttcaattgctttagaaacaatagtccctgcctgggtacccttagtttcaagaatatttgcccttgtttaaatacctatcactgtggtagagcttgcattgcttctttcccacaagtattaaactgcccatatgtgaatatgcaaagcctttatgaatctataataatggtacttcatctggggagagtgtaatattttggaccgctgcttttcttttcccttaatgaggagagcaacaggccactgattacggttccaaagtactgagatgttaattataactcagccagtaagtacatgtctcctgttgggaggatttgtgtaatagacatcaaactgctagcctggtattatgaagatgaacatggtaataacttttaatagaatagttaataaatgaaactagttcctataacatctttatttaaaagcttagcctgccttaaaactagagatcaaactttgtcaactgcagaagcttcttagcctttcaaaaaaaagttcatactttataaaattgcacagagcaattttccacaccttcccccacattactcccacattataaagtattcttcctaatgttgctttagtatttattacagttttaaaaaagggtttgaaatatagctgttctttaaggataaaatatccagccaggaccattactgccagagagaaaaattttattgaatggccattatttccctactttgaagatgtttcaatctgaatttatttggctacactaaagaatgcagtatatttagttttccatttgcatgatgtgtgtttgtgctatagatgatattttaaattgaaaaatttgttttaaattatttttacagtgaagactgttttcagctctttttatattgtacatagtcttttatgtaatctactggcatatgttttgtagactgtttaatgactggatatcttcctccaacttttgaaatacaaaaccagtgttttatacttgtacactgttttaaaaagtctattaaaattgtcatttgacttttttgttaaatta

SEQ ID NO: 138 - protein, 745 aa, Canis familiaris
MADEAALALQPGGSPSAVAAEREAASPPAGEPLRKRPRRDCPGLGRSPGEPGGAAPEREVPAATGGCSAAAAALWREAAAGGEREAQAAVAAAGEGDNGPGLQGLTREPLPADDFVDDDDDDEGEEEEEAAAASAIGYRDNLLFDDEIITNGFHSCESDEDDRASHASSSDWTPRPRIGPYTFVQQHLMIGTDPRTILKDLLPETIPPPELDDMTLWQIVINILSEPPKRKKRKDINTIEDAVKLLQECKKIIVLTGAGVSVSCGIPDFRSRDGIYARLAIDFPDLPDPQAMFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAHLSELPPTPLNISEDSSSPERTSPPDSSVIVTLLDEATKSNVDDPGVSESRDCMEEKSQEGQNSIRNIESVTEHLESPDLKNVGCNTGEKNERTSVADPVRKCWPARLAKEQISKRLDGNQYLFLPPNRYIFHGAEVYSDSEDDVLSSSSCGSNSDSGTCQSPSLEEHLEDESEIEEFYNGLEDEADVNERAGGTGFGIDGGDQEAVNEAISMKQEATDTNYPSNKS

SEQ ID NO: 139 - DNA, 3684 bp, Canis familiaris
  CDS (224)..(1897)
tccctccgccgcccgcctgcgcggctttgcgctttgcgcagccgccgggccgcgaagctcccgcagttggttttaaaataaccttctgtttgatgatgaaataatcaccaacggttttcattcctgtgaaagtgatgaggatgatagagcctcacatgcaagctctagtgactggactccaaggccccggataggtccatatacttttgttcagcaacatctcatgattggcacagatccacgaacaattcttaaagatttactaccagaaacaattcctccacctgaattggatgatatgacactgtggcagattgttattaatatcctttcagaaccaccaaaaaggaagaaaagaaaagatattaatacaattgaagatgctgtgaaattactgcaagagtgcaaaaaaataatagttctaactggagctggggtttctgtttcttgtggaatacctgacttcaggtcaagagatggtatttatgctcgccttgcaatagacttcccagaccttccagatcctcaagcaatgtttgacattgaatatttcagaaaggatccaagaccattcttcaagtttgcaaaggaaatctatcccggacagttccaaccatctctctgtcacaaattcatagccttgtcagataaggaaggaaaactacttcggaactatactcagaacatagatacactggaacaggttgcaggaatccaaaggataattcagtgtcatggttcctttgcaacagcatcttgcctgatttgtaaatacaaagtagactgtgaagctgtacgaggagatatttttaatcaggtggttcctcgttgtcctaggtgcccagctgatgagccacttgctatcatgaaaccagagattgtcttttttggtgaaaatttaccagagcagtttcatagagccatgaagtatgacaaagacgaagttgatctcctcattgtaattgggtcttccctgaaagtaagaccagtagcactaattccaagttccataccccatgaagtgcctcagatattaataaatagagaacctttgcctcatctgcattttgatgtagagcttcttggagactgtgatgtcataataaatgaattatgtcataggttaggtggtgaatatgccaaactttgctgcaaccctgtaaagctttcagaaatcactgaaaagcctccacgaacacaaaaagagttggctcatttgtcagagttgccacccacacctcttaatatttcagaagactccagttcaccggaaagaacttcaccaccagattcttcagtgattgttacgcttttagacgaagcaactaagagtaatgttgatgatcccggtgtgtccgaatcaagagattgtatggaagaaaaatcacaggaaggacagaattctattaggaacattgaaagtgtcactgaacatctggaaagtccggatttgaagaatgttggctgtaatactggggagaaaaatgaaagaacttcagttgctgacccggtgaggaagtgctggccagctagacttgcaaaggagcagattagcaaacggcttgatggtaaccagtatctctttttaccaccaaatcgttacattttccatggcgctgaggtatattcagactctgaagatgacgtcttatcctctagttcttgtggcagtaacagtgatagtggaacctgccagagtccaagtttagaagaacacttggaggatgaaagtgagattgaagaattttacaatggtttggaagatgaagctgatgtcaatgagagagctggaggaactggatttggaattgatggaggtgatcaagaggcagtcaatgaagctatatccatgaaacaggaagcaacagatactaactatccatcaaacaaatcataatgtagtaattgtccaggtacaggaattgttccaccagcattaggaatttcagcatgtcaaaatgaatgtttacttgtgaattcaacagagcaaggaaaccagaaaggtgtaatatttatagactggtaaattagattgttttttcatggataatttttaacttcttatttctgtacttgtacactcaacactaactttttttaaaagaagggtactaagtatctttaatcacatgttggtcaagacttttcttttaaaggttcatttgtatgatacatccatatgtatatataattttgttcttgcctagtgaatttcaacattttaaagttttcaaaaagccattggaatgttaaattaatgtaaagggaacagcttatctagaccaaagaatggtattttcacacttttctttgtaacattgaatggtttgaactccttaaatgtctgttctgctaaacttttgattctttattagcacacaattacctatttttaaacactggcattttccaaaacttgtggcagctaactttttaaaaatttcatgacatgcagtatgtatagagggaagtcaacaatatgtgggagagcacttagttgtccttgctttttaaagtaagacttggtgctaagagtttcaggaatactgtattgttgaagatggcttttgtacttcctgtggacatgtagtaatgtctatattggctcctaaaactaagctgaaaaaaaataaatgctttggaaatgtttcaattgctttagaaacaatagtccctgcctgggtacccttagtttcaagaatatttgcccttgtttaaatacctatcactgtggtagagcttgcattgcttctttcccacaagtattaaactgcccatatgtgaatatgcaaagcctttatgaatctataataatggtacttcatctggggagagtgtaatattttggaccgctgcttttcttttcccttaatgaggagagcaacaggccactgattacggttccaaagtactgagatgttaattataactcagccagtaagtacatgtctcctgttgggaggatttgtgtaatagacatcaaactgctagcctggtattatgaagatgaacatggtaataacttttaatagaatagttaataaatgaaactagttcctataacatctttatttaaaagcttagcctgccttaaaactagagatcaaactttgtcaactgcagaagcttcttagcctttcaaaaaaaagttcatactttataaaattgcacagagcaattttccacaccttcccccacattactcccacattataaagtattcttcctaatgttgctttagtatttattacagttttaaaaaagggtttgaaatatagctgttctttaaggataaaatatccagccaggaccattactgccagagagaaaaattttattgaatggccattatttccctactttgaagatgtttcaatctgaatttatttggctacactaaagaatgcagtatatttagttttccatttgcatgatgtgtgtttgtgctatagatgatattttaaattgaaaaatttgttttaaattatttttacagtgaagactgttttcagctctttttatattgtacatagtcttttatgtaatctactggcatatgttttgtagactgtttaatgactggatatcttcctccaacttttgaaatacaaaaccagtgttttatacttgtacactgttttaaaaagtctattaaaattgtcatttgacttttttgttaaatta

SEQ ID NO: 140 - protein, 557 aa, Canis familiaris
MIGTDPRTILKDLLPETIPPPELDDMTLWQIVINILSEPPKRKKRKDINTIEDAVKLLQECKKIIVLTGAGVSVSCGIPDFRSRDGIYARLAIDFPDLPDPQAMFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAHLSELPPTPLNISEDSSSPERTSPPDSSVIVTLLDEATKSNVDDPGVSESRDCMEEKSQEGQNSIRNIESVTEHLESPDLKNVGCNTGEKNERTSVADPVRKCWPARLAKEQISKRLDGNQYLFLPPNRYIFHGAEVYSDSEDDVLSSSSCGSNSDSGTCQSPSLEEHLEDESEIEEFYNGLEDEADVNERAGGTGFGIDGGDQEAVNEAISMKQEATDTNYPSNKS

SEQ ID NO: 141 - DNA, 4121 bp, Pan troglodytes
  CDS (80)..(2335)
gagccgcgggggcgccactgccgcgcgtcgagcgggagcagaggaggcgagggaggagggccagagaggcagttggaagatggcggacgaggcggccctcgcccttcagcccggcggctccccctcggcggcgggggccgacagggaggccgcgtcgtcccccgccggggagccgctccgcaagaggccgcggagagatggtcccggcctcgagcggagcccgggcgagcccggtggggcggccccagagcgtgaggtgccggcggcggccaggggctgcccgggtgcggcggcggcggcgctgtggcgggaggcggaggcagagacggcggcgacggcggcggcggcgggcggggagcaagaggcccaggcgactgcggcggctggggaaggagacaatgggccgggcctgcagggcccatctcgggagccaccgctggccgacaacttctacgacgaagacgacgacgacgagggcgaggaggaggaagaggcggcggcggcggcgattgggtaccgagataaccttctgttcggtgatgaaattatcactaatggttttcattcctgtgaaagtgatgaggaggatagagcctcacatgcaagctctagtgactggactccaaggccacggataggtccatatacttttgttcagcaacatcttatgattggcacagatcctcgaacaattcttaaagatttattgccggaaacaatacctccacctgagttggatgatatgacactgtggcagattgttattaatatcctttcagaaccaccaaaaaggaaaaaaagaaaagatattaatacaattgaagatgctgtgaaattactgcaagagtgcaaaaaaattatagttctaactggagctggggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggaaatatatcctggacaattccagccatctctctgtcacaaattcatagccttgtcagataaggaaggaaaactacttcgcaactatacccaaaacatagacacgctggaacaggttgcgggaatccaaaggataattcagtgtcatggttcctttgcaacagcatcttgcctaatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacagaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaagcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagaaagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaggtactaagtatctttaatcagctgttggtcaagactttcttttaaaggttcatttgtatgataaattcatatgtgtatatgtaattttttttgttttgtctagtgagtttcaacatttttaaagttttcaaaaagccatcggaatgttaaattaatgtaaagggaacagcttatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagtaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttgtactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagcctagtattatggagatgaacatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcagtctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatctactggcatatgttttgtagactgtttaatgactggatatcttccttcaacttttgaaatacaaaaccagtgttttttacttgtacactgttttaaagtctattaaaattgtcatttgacttttttctgttaactta

SEQ ID NO: 142 - protein, 751 aa, Pan troglodytes
MADEAALALQPGGSPSAAGADREAASSPAGEPLRKRPRRDGPGLERSPGEPGGAAPEREVPAAARGCPGAAAAALWREAEAETAATAAAAGGEQEAQATAAAGEGDNGPGLQGPSREPPLADNFYDEDDDDEGEEEEEAAAAAIGYRDNLLFGDEIITNGFHSCESDEEDRASHASSSDWTPRPRIGPYTFVQQHLMIGTDPRTILKDLLPETIPPPELDDMTLWQIVINILSEPPKRKKRKDINTIEDAVKLLQECKKIIVLTGAGVSVSCGIPDFRSRDGIYARLAVDFPDLPDPQAMFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAYLSELPPTPLHVSEDSSSPERTSPPDSSVIVTLLDQAAKSNDDLDVSESKGCMEEKPQEVQTSRNVESIAEQMENPDLKNVGSSTGEKNERTSVAGTVRKCWPNRVAKEQISKRLDGNQYLFLPPNRYIFHGAEVYSDSEDDVLSSSSCGSNSDSGTCQSPSLEEPMEDESEIEEFYNGLEDEPDVPERAGGAGFGTDGDDQEAINEAISVKQEVTDMNYPSNKS

SEQ ID NO: 143 - DNA, 3829 bp, Pan troglodytes
  CDS (376)..(2043)
ccggaactgcgcatctcctcctccctctccccgggctcctactggcctgaggttgagggcggctgggggctcggggcaggctccgcggcgttcccctccccaccccggccctccgttcagccgcgcttctccggggctgcggttcctactgcgcgagctgccagtggattcgctctttccctccgtccgtggcccgcctgggcggccttgttctttccgcagcagccagataaccttctgttcggtgatgaaattatcactaatggttttcattcctgtgaaagtgatgaggaggatagagcctcacatgcaagctctagtgactggactccaaggccacggataggtccatatacttttgttcagcaacatcttatgattggcacagatcctcgaacaattcttaaagatttattgccggaaacaatacctccacctgagttggatgatatgacactgtggcagattgttattaatatcctttcagaaccaccaaaaaggaaaaaaagaaaagatattaatacaattgaagatgctgtgaaattactgcaagagtgcaaaaaaattatagttctaactggagctggggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggaaatatatcctggacaattccagccatctctctgtcacaaattcatagccttgtcagataaggaaggaaaactacttcgcaactatacccaaaacatagacacgctggaacaggttgcgggaatccaaaggataattcagtgtcatggttcctttgcaacagcatcttgcctaatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacagaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaagcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagaaagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaggtactaagtatctttaatcagctgttggtcaagactttcttttaaaggttcatttgtatgataaattcatatgtgtatatgtaattttttttgttttgtctagtgagtttcaacatttttaaagttttcaaaaagccatcggaatgttaaattaatgtaaagggaacagcttatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagtaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttgtactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagcctagtattatggagatgaacatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcagtctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatctactggcatatgttttgtagactgtttaatgactggatatcttccttcaacttttgaaatacaaaaccagtgttttttacttgtacactgttttaaagtctattaaaattgtcatttgacttttttctgttaactta

SEQ ID NO: 144 - protein, 555 aa, Pan troglodytes
MIGTDPRTILKDLLPETIPPPELDDMTLWQIVINILSEPPKRKKRKDINTIEDAVKLLQECKKIIVLTGAGVSVSCGIPDFRSRDGIYARLAVDFPDLPDPQAMFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAYLSELPPTPLHVSEDSSSPERTSPPDSSVIVTLLDQAAKSNDDLDVSESKGCMEEKPQEVQTSRNVESIAEQMENPDLKNVGSSTGEKNERTSVAGTVRKCWPNRVAKEQISKRLDGNQYLFLPPNRYIFHGAEVYSDSEDDVLSSSSCGSNSDSGTCQSPSLEEPMEDESEIEEFYNGLEDEPDVPERAGGAGFGTDGDDQEAINEAISVKQEVTDMNYPSNKS

SEQ ID NO: 145 - DNA, 4161 bp, Equus caballus
  CDS (143)..(1504)
tcttctgtttggtgatgaaataatcaccaacggttttcattcttgtgaaagtgatgaggatgatagagcctcacatgcaagctctagtgactggaccccaaggccacggataggtccatatacttttgttcagcaacatctcatgattggcacagatcctcgaacaattcttaaagatttgctaccagaaacaattcctccacctgaattggatgatatgacactgtggcagattgttattaatatcctttcagaaccaccaaaaaggaaaaaaagaaaagatattaatacaattgaagatgctgtgaaattactgcaagagtgcaagaaaataatagttctaactggagctggggtttctgtttcttgtggaatacctgacttcaggtcaagagatggtatttatgctcgccttgcagtagacttcccagaccttccagatcctcaagcaatgtttgatattgaatatttcaggaaagatccaagaccattcttcaagtttgcaaaggaaatatatcctggacagttccagccatctctctgtcacaaattcatagctttgtcagataaggaaggaaaactacttcgcaactatactcagaacatagatacactggaacaggttgcaggaatccaaaggataattcagtgtcacggttcctttgcaacagcgtcttgcctgatttgtaaatacaaagttgactgtgaagctgtacgaggagatatttttaatcaggtggttcctcgatgtcccaggtgcccagctgatgaaccacttgctatcatgaaaccagagattgttttttttggtgaaaatttaccagaacagtttcatagagccatgaaatatgacaaagatgaagttgatctcctcatcgttattgggtcttccctgaaagtaagaccagtagcactaattccaagttccataccccatgaagtgcctcagatattaattaatagggaacctttgcctcatctgcattttgatgtagagcttcttggagactgtgatgtcataattaatgaattgtgtcataggttaggtggtgaatatgccaaactttgctgcaaccctataaagctttcagaaattactgaaaaacctccacgaacacaaagagagttggctcatttgtcagaattgccacccacacctcttaatatttcagaagactcaagttcaccagaaagaacttcaccaccagattcgtccgtgattgtcacacttttagaccaagcaacaaagagtaatgttgatgatccagatgtgtccaaatcaaaagattgtatggaagaaaaatcacaggaagtacagacatctactaggagctttcaaagtgttactgaacggttgggaagtccgtatttgaagaatgttggctctgatactggggagaaaaatgaaagaacttcagttgctgaagcagtaagaaagtgctggccagctagactcgcaaaggagcagattagtaaacggcttgatggtaagaaaggctgttgagccattttaaaggcataattattgtaacaagatatttccaagaaatgagcaattttggcaggttagttgacagggtagctttatgcagctgaatgtaacagttgattgtgtttagagaaactataacgttgagaatttaagctagagaacgataaacactggtatcttacatagtatgggggagaaatagtgtttaatttataaagtgtgccctataccttgtgtttttctagagaataagcactaaattgaaaagaaaacagaaatattgagagctatgctgttgtctggtgagagctttagcgggtagaaatgatgcctgagaattgggtgcttactgtgggtcagctgttttatacacattatctgattttaatctcatgagttaggaactattactactactctgctacaggtgagaaaactgagtacagtagaggttaagtatcccatgcaaagtaacacctgggacacggaagagccagattggattcctgtctatcctcagagcgtatcctcttaaccattgtgctgtgttatctcagatctagaaaatctccgattcctctccactgaatattaggaatagcatctaccctgttttgacatatgggaagtctttaccaattagtattaaattaacatagatgaaatcacttttttggaaatcagtgtttaagtccaagcagcatttttggcaaaaaattttaatttaatcaaaataaaaaacatgcgctctttaactaagaagcaacagtcttgtatgacttaaacattaagtcccactccatttaccatccagggtgaaaactgacaaatttagacaagttctaagcatgtgctgtaaatgaattttagttcagtcgaataagcctttgggccttttccatagtaagcattgtagcaagttctggagagacaacaaactactgatgttttgtgtataattataaaaataggtgattaaaaaataggtgatgttaaaaaaaggtagaggctgcttggaggggtttaggtatagaaggctttccagaaaatctaactcctgactttggttttgaacaataagtagagagttaaaagtaggggaagtcttcccaggggaaactagaaaaggcattagaatgcttatgtttgcaaatgtggcaagtcagaagtagaaaaattgttactgatttagtcaggtaatatggttttttttttggctgagtaggatttgaccaagctaacattcatgccaaccctcctctatctctttctaagtatgtgggccgccagcagaagcgcagctgctaacagagcagtgtaggtctgctcctgggaaccgaacccaggctaccaaagcagagtgtgctgaactttaaccactaggccaccggggctggcccctacaagtttctaccatatacaaggtctctgtatgcactggaagactttttgcactggggattttctttgaatatctttttgacagatgggtcacacacaaagaactctttgccccaggaaacgaaaattaaacatggagcagtctctttggtattatactttggttttactctactcatttaggccttaaaggtgcaggctttggaattagacctgagctgtctcagatctacaccttgggtagtcatttaatctctgtttcttaatccaatctgtaaaatgggaagaaaatagcacatacttgatagcattgtgagaatttaaaaagaaaactgacgtagggtataaaattgtagctgttaaaaccaaatgaccactaggctttactcattttattttgccactatttctgttgtgaggtcaaggcaaaaggaagtgggagcatatatgaggtaagctttgaatctgtcttgatggttgccaagaaaggggcaaaactagacatgtgtagggtatttgggctgagaaatagattattcagttcttcgggggggccagagcagaacaaagcattttttagaagatgggccaaaactatagaaagaaaagtggaagacaacctgtgttgggactccttaaaagactaagcgggtgtgattcaaaggagatggccctattttctgttagcaggtagaatacaagtacttgacaccctcctctgatcatgaaaattaatagttgtggcttagaaaactgaagaatattatgtattctcttgaaaaagaaggaagtaagtggttttcacactgcaatttgtgatctgtgagtggattaatcagttttgtgggttcagatcagaattgtcacatatattaggttgtttcagaccagaaaactgggtcttgatggggataataaagtttgaaagctattttgaagagaaacttaggtcggcttggtagatggcatgtactccagatcaagtgtgtagtagttgggcttttgtgaatctgtcattacatgtgaaaacagacttaagttagaagttacttgttcttgtgaatttcagtgtagaaaacatttcatcattaatgtttagggttcccacccattctcttaaaagtctcagcttggtcaaatttaatttagcttcttttgtttacattgtgatttttaagaactttattagtattcctggactcaaactgatagattttctttcttctcgttttttgtttttggtgaggaagattgtccctgagctaaca

SEQ ID NO: 146 - protein, 453 aa, Equus caballus
MIGTDPRTILKDLLPETIPPPELDDMTLWQIVINILSEPPKRKKRKDINTIEDAVKLLQECKKIIVLTGAGVSVSCGIPDFRSRDGIYARLAVDFPDLPDPQAMFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPIKLSEITEKPPRTQRELAHLSELPPTPLNISEDSSSPERTSPPDSSVIVTLLDQATKSNVDDPDVSKSKDCMEEKSQEVQTSTRSFQSVTERLGSPYLKNVGSDTGEKNERTSVAEAVRKCWPARLAKEQISKRLDGKKGC

SEQ ID NO: 147 - DNA, 4090 bp, Macaca mulatta
  CDS (65)..(2296)
cagtgccgcgcgtcgagcgggagcagaggaggcgagggaggagggccagagaggcagttggaagatggcggacgaggcggccctcgcccttcagcccggcggctccccctcggcggcgggggccgagagggaggccgggtcgccccccgccggggagccgctccgcaagaggccgcggagagatggtcctggcctcgagcggagcccgggcgagcccggtggggcagccccagagcgtgaggtgccggcggccgggggctgcccggttgcggcggcggcgctgtggcgggaggcagaggcggcggcggcgggcggggagcaagaggcccaggcgactgcggcggctggggaaggagacaatgggccgggcctgcagggcccatctcgggagccaccgctggccgacagcttctacgacgaagacgacgacgacgagggcgaggaggaggaagaggcggcggcggcggcgattgggtaccgagataaccttctgttcggtgatgaaattatcactaatggttttcattcttgtgaaagtgatgaggaggatagagcctcacatgcaagctctagtgactggactccaaggccacggataggtccatatacttttgttcagcaacatcttatgattggcacagatcctcgaacaattcttaaagatttattgccggaaacaattcctccacctgagttggatgatatgacactgtggcagattgttattaatatcctttcagaaccaccaaaaaggaaaaaaagaaaagatattaatacaattgaagatgctgtgaaattactgcaagagtgcaaaaaaattatagttctaactggagctggggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggaaatatatcctggacaattccaaccatctctctgtcacaaattcatagccttgtcagataaggaaggaaaactacttcgcaactatacccagaacatagacacgctggaacaggttgcgggaatccagaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccggtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacccccacgaacacaaaaagaattggcttatttgtcagacttgccacccacacctcttcatatttcagaagactcaagttcaccagaaagaacttcaccaccagattcttcagtgattgtcacacttttagaccaagcagctaagagtaatgatgatttagatgtgtctgaatcaaaaggtcgtatggaagaaaaaccacaggaagtacagacttctaggaatgttgaaagtattgctgaacacatgggaaatccggatttgaagaatgttggttccagtactggggagaaaaatgaaagaacctcagtggctggaacagtgagaaaatgctggcctagtagagtggcaaaggagcagattagtaagcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatattccagagagagctggaggagctggatttgggactgatggagatgatcaagaggcaattaatgaagctatatctatgaaacaggaagtaacagacatgaactatccatcaaacaaatcatagtgtaataattgtgcaggtacaggaattgttccaccagcattaggaactttagcatgtcaaaatgaatgtttacttgtgaactctatagagcaaggaaaccagaaaggtaatatttatagattggtaaaatagattgtttttcatggataatttttaacttcattatttctgtacttgtacaaattcaacactaactttttttttttttaaaaaaaaggtactaagtatctttaatcagctgttggtcaagactaactttcttttaaagattcatttgtatgataaattcatatgtatatataatttttgtttttgtctagtgagtttcaacatttttaaagttttcaaaaagccatcggaatgttaaattaatgtaaagggaacagcttatctagaccaaagaatggtattttcacttttctttgtaacattgaatggtttgaagtactcaaaatctgttaactctaaacttttgattctttaacacaattacttatttttaaacactggcattttccaaaacttgtggcagctaactttttaaaatctcaaatgacatgcaatgtgagtagaaggaagtcgacaataggtgggagggcactcggttgtctttacttttaaaagtaatacttggtgctaagaatttcaggattattgtatttatgttcaaatgaagatggcttttgtacttcctgtggacatgtagtaatgtctatattggctcataaaactaacctgaaaaacaaataaatgctttggaaatgtttcagttgctttagaaacaatagtgcctgcctggatccccttagttttgaaatatttgccattgttgtttaaatacctatcactgtggtagagcttgcattgatcttttccacaagtattaaactgccaaaatgtgaatatgcaaagcctttccgaatctataataatggtacttctactggggagagtgtaatattttggactgctgttttccattaatgaggagagcaacaggcccctgattacagttccaaagtaataagatgttaattataactcagccagaaagtacatgtctccttccattgggaggatttggtgttaaataccaaactgctagcctagtattatggagatgaacatgatgtaacttgtaatagcagaatagttaatgaatgaaactagttcttataatttatctttatttaaaagcttagcctgccttaaaactagagatcaactttctcagctgcaaaagcttctagtctttcaagaagttcttactttatgaaattgcaccgtaagcatttatttttcagaccatttttgaacattactcccaaattaataaagtattcctctgttgctttagtatttattacaataaaaagggtttgaaatatagctgttctttatgcataaaatacccagctaggaccattactgccagagaaaaaaaatcgtatctgaatggccatttccctacttaaaagatttctgaatctgaatttatttggctacactaaagaatgcagtatatttagttttccatttgcatgatgtgtttgtgctatagataatattttaaattgaaaagtttgttttaaattatttttacagtgaagactgttttcagctctttttatattgtacatagtcttttatgtaatctactggcatatgttttgtagactgtttaatgactggatatcttccttcaacttttgaaatacaaaaccagtgtttttttacttgtacactgttttaaagtctattaaaactgtcatttgacttttttctgttaactta

SEQ ID NO: 148 - protein, 743 aa, Macaca mulatta
MADEAALALQPGGSPSAAGAEREAGSPPAGEPLRKRPRRDGPGLERSPGEPGGAAPEREVPAAGGCPVAAAALWREAEAAAAGGEQEAQATAAAGEGDNGPGLQGPSREPPLADSFYDEDDDDEGEEEEEAAAAAIGYRDNLLFGDEIITNGFHSCESDEEDRASHASSSDWTPRPRIGPYTFVQQHLMIGTDPRTILKDLLPETIPPPELDDMTLWQIVINILSEPPKRKKRKDINTIEDAVKLLQECKKIIVLTGAGVSVSCGIPDFRSRDGIYARLAVDFPDLPDPQAMFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAYLSDLPPTPLHISEDSSSPERTSPPDSSVIVTLLDQAAKSNDDLDVSESKGRMEEKPQEVQTSRNVESIAEHMGNPDLKNVGSSTGEKNERTSVAGTVRKCWPSRVAKEQISKRLDGNQYLFLPPNRYIFHGAEVYSDSEDDVLSSSSCGSNSDSGTCQSPSLEEPMEDESEIEEFYNGLEDEPDIPERAGGAGFGTDGDDQEAINEAISMKQEVTDMNYPSNKS

SEQ ID NO: 149 - DNA, 3374 bp, Macaca mulatta
  CDS (246)..(1580)
gtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaagaagaaacagcattgaagcattatttggggggaaaaacacacacacaaaatccagcaactcagcattcatgagcaactctatactataccagtatgtgcctgtgcagtggaaggaaaacaattttggaaatatatcctggacaattccaaccatctctctgtcacaaattcatagccttgtcagataaggaaggaaaactacttcgcaactatacccagaacatagacacgctggaacaggttgcgggaatccagaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccggtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacccccacgaacacaaaaagaattggcttatttgtcagacttgccacccacacctcttcatatttcagaagactcaagttcaccagaaagaacttcaccaccagattcttcagtgattgtcacacttttagaccaagcagctaagagtaatgatgatttagatgtgtctgaatcaaaaggtcgtatggaagaaaaaccacaggaagtacagacttctaggaatgttgaaagtattgctgaacacatgggaaatccggatttgaagaatgttggttccagtactggggagaaaaatgaaagaacctcagtggctggaacagtgagaaaatgctggcctagtagagtggcaaaggagcagattagtaagcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatattccagagagagctggaggagctggatttgggactgatggagatgatcaagaggcaattaatgaagctatatctatgaaacaggaagtaacagacatgaactatccatcaaacaaatcatagtgtaataattgtgcaggtacaggaattgttccaccagcattaggaactttagcatgtcaaaatgaatgtttacttgtgaactctatagagcaaggaaaccagaaaggtaatatttatagattggtaaaatagattgtttttcatggataatttttaacttcattatttctgtacttgtacaaattcaacactaactttttttttttttaaaaaaaaggtactaagtatctttaatcagctgttggtcaagactaactttcttttaaagattcatttgtatgataaattcatatgtatatataatttttgtttttgtctagtgagtttcaacatttttaaagttttcaaaaagccatcggaatgttaaattaatgtaaagggaacagcttatctagaccaaagaatggtattttcacttttctttgtaacattgaatggtttgaagtactcaaaatctgttaactctaaacttttgattctttaacacaattacttatttttaaacactggcattttccaaaacttgtggcagctaactttttaaaatctcaaatgacatgcaatgtgagtagaaggaagtcgacaataggtgggagggcactcggttgtctttacttttaaaagtaatacttggtgctaagaatttcaggattattgtatttatgttcaaatgaagatggcttttgtacttcctgtggacatgtagtaatgtctatattggctcataaaactaacctgaaaaacaaataaatgctttggaaatgtttcagttgctttagaaacaatagtgcctgcctggatccccttagttttgaaatatttgccattgttgtttaaatacctatcactgtggtagagcttgcattgatcttttccacaagtattaaactgccaaaatgtgaatatgcaaagcctttccgaatctataataatggtacttctactggggagagtgtaatattttggactgctgttttccattaatgaggagagcaacaggcccctgattacagttccaaagtaataagatgttaattataactcagccagaaagtacatgtctccttccattgggaggatttggtgttaaataccaaactgctagcctagtattatggagatgaacatgatgtaacttgtaatagcagaatagttaatgaatgaaactagttcttataatttatctttatttaaaagcttagcctgccttaaaactagagatcaactttctcagctgcaaaagcttctagtctttcaagaagttcttactttatgaaattgcaccgtaagcatttatttttcagaccatttttgaacattactcccaaattaataaagtattcctctgttgctttagtatttattacaataaaaagggtttgaaatatagctgttctttatgcataaaatacccagctaggaccattactgccagagaaaaaaaatcgtatctgaatggccatttccctacttaaaagatttctgaatctgaatttatttggctacactaaagaatgcagtatatttagttttccatttgcatgatgtgtttgtgctatagataatattttaaattgaaaagtttgttttaaattatttttacagtgaagactgttttcagctctttttatattgtacatagtcttttatgtaatctactggcatatgttttgtagactgtttaatgactggatatcttccttcaacttttgaaatacaaaaccagtgtttttttacttgtacactgttttaaagtctattaaaactgtcatttgacttttttctgttaactta

SEQ ID NO: 150 - protein, 444 aa, Macaca mulatta
MCLCSGRKTILEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAYLSDLPPTPLHISEDSSSPERTSPPDSSVIVTLLDQAAKSNDDLDVSESKGRMEEKPQEVQTSRNVESIAEHMGNPDLKNVGSSTGEKNERTSVAGTVRKCWPSRVAKEQISKRLDGNQYLFLPPNRYIFHGAEVYSDSEDDVLSSSSCGSNSDSGTCQSPSLEEPMEDESEIEEFYNGLEDEPDIPERAGGAGFGTDGDDQEAINEAISMKQEVTDMNYPSNKS

SEQ ID NO: 151 - DNA, 4118 bp, Pongo abelii
  CDS (86)..(2329)
  misc_feature (377)..(377): n is a, c, g, or t
cagccggagccgcgggggcgccagtgccgcgcgtcgagcgggagcagaggaggcgagggaggagggccagagaggcagttggaagatggcggacgaggcggccctcgcccttcagcccggcggctccccctcggcggcgggggccgagagggaggccgcgtcgtcccccgccggggagccgctccgcaagaggccgcggagagacggtcccggcctcgagcggagcccgggcgagcccggtggggcggccccagagcgtgaggtgccggcggcggccgggggctgcccggctgcggcggcggcgctgtggcgggaggcggaggcagaggcggcggcgggcggggagcaagaggcccaggcgactgcggcggctgggnaaggagacaatgggccgggcctgcagggcccatctcgggagccaccgctggccgacaacttctacgacgaagacgacgacgacgacgagggcgaggaggaggaagaggcggcggcggcggcggcgattgggtaccgagataaccttctgttcggtgatgaaattatcactaatggttttcattcctgtgaaagtgatgaggaggatagagcctcacatgcaagctctagtgactggactccgaggccacggataggtccatatacttttgttcagcaacatcttatgattggcacagatcctcgaacaattcttaaagatttattgccggaaacaattcctccacctgagttggatgatatgacactgtggcagattgttattaatatcctttcagaaccaccaaaaaggaaaaaaagaaaagatattaatacaattgaagatgctgtgaaattactgcaagagtgcaaaaaaattatagttctaactggagctggggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggaaatatatcctggacaattccaaccatctctctgtcacaaattcatagccttgtcagataaggaaggaaaactactacgcaactatacccagaacatagacacgctggagcaggttgcaggaatccaaaggataattcagtgtcatggttcctttgcaacagcatcttgcctgatttgtaaatacaaagttgactgtgaagctgtacgaggagatatttttaatcaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatatttcagaagactcaagttcaccagaaagaagttcaccaccagattcttcagtgattgtcacacttttagaccaagcagctaagagtaatgatgatttagatgtgtctgaatcaaaaggttgtatggaagaaaaaccacaggaagtacaaacttctaggaacgttgaaagtattgctgaacagatggaaaatccggatttgaagaatgttggttccagtactggggagaaaaatgaaagaacttcagtgactggaacagtgagaaaatgctggcctaatagagtggcaaaggagcagattagtaagcggcttgatggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattgatgaagctatatctatgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgttttcatggataatttttaacttcattatttctgtacttgtacaaactcaacactaactttttttttaaaaaaagaaaggtactaagtatctttaatcagctgttggtcaagactaactttcttttaaaggttcatttgtatgataaattcatatgtgtatatattttttttgtttgtttttgtctagtgagtttcaacatttttaaagttttcaaaaagccatcagaatgttaaattaatgtaaagggaacagcttatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcaatatgagtagaaggaagtcaacaatatgtggggagagcactcggttgtctttacttttaaaagtaatacttggtgctaagaatttcaggattattgtatttatgttcaaatgaagatggcttttgtacttcctgtggacatgtagtaatgtctatattggctcataaaactaacctgaaaaacaaataaatgctttggaaatgtttcagttgctttagaaacaatagtgcctgcctggatccccttagttttgaaatatttgccattgttgtttaaatacctatcactgtggtagagcttgcattgattttttccacaagtattaaactgccaaaatgtgaatatgcaaagcctttctgaatctataataatggtacttctactggggagagtgtaatattttggactgctgttttccattaatgaggagagcaacaggcccctgattacagttccaaagtaataagatgttaatggtaattcagccagaaagtacatgtctcccgttgggaggatttggtgttaaataccaaactgctagcctagtattatggagatgaacatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacattactcctaaattaataaagtattcctctgttgctttagtatttattacaataaaaagggttttaaatatagctgttctttatgcataaaatacccagctaggaccattactgccagagaaaaaaatcgtattgaatggccatttccctacttagaagatgtctcaatctgaatttatttggctacactaaagaatgcagtatatttagttttccatttgcatgatgtgtttgtgctatagatgatattttaaattgaaaagtttgttttaaattatttttacagtgaagactgttttcagctctttttatattgtacatagtcttttatgtaatctactggcctatgttttgtagactgtttaatgactggatatcttccttcaacttttgaaatacaaaaccagtgttttttacttgtacactgttttaaagtctattaaaattgtcatttgacttttttctgttaactta

SEQ ID NO: 152 - protein, 747 aa, Pongo abelii
  misc_feature (98)..(98): The 'Xaa' at location 98 stands for Lys, Glu, or Gln.
MADEAALALQPGGSPSAAGAEREAASSPAGEPLRKRPRRDGPGLERSPGEPGGAAPEREVPAAAGGCPAAAAALWREAEAEAAAGGEQEAQATAAAGXGDNGPGLQGPSREPPLADNFYDEDDDDDEGEEEEEAAAAAAIGYRDNLLFGDEIITNGFHSCESDEEDRASHASSSDWTPRPRIGPYTFVQQHLMIGTDPRTILKDLLPETIPPPELDDMTLWQIVINILSEPPKRKKRKDINTIEDAVKLLQECKKIIVLTGAGVSVSCGIPDFRSRDGIYARLAVDFPDLPDPQAMFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAYLSELPPTPLHISEDSSSPERSSPPDSSVIVTLLDQAAKSNDDLDVSESKGCMEEKPQEVQTSRNVESIAEQMENPDLKNVGSSTGEKNERTSVTGTVRKCWPNRVAKEQISKRLDGNQYLFLPPNRYIFHGAEVYSDSEDDVLSSSSCGSNSDSGTCQSPSLEEPMEDESEIEEFYNGLEDEPDVPERAGGAGFGTDGDDQEAIDEAISMKQEVTDMNYPSNKS

SEQ ID NO: 153 - DNA, 19 bp, Homo sapiens
gtcctgggggtgcaataag

SEQ ID NO: 154 - DNA, 20 bp, Homo sapiens
cccctcacctcccttctatt

SEQ ID NO: 155 - DNA, 20 bp, Homo sapiens
actgaccttccacacccaag

SEQ ID NO: 156 - DNA, 20 bp, Homo sapiens
ggaggaagcatgacaaggaa

SEQ ID NO: 157 - DNA, 20 bp, Artificial Sequence
  Artificially synthesized oligonucleotide primer
cctatcccaccccttcacca

SEQ ID NO: 158 - DNA, 20 bp, Artificial Sequence
  Artificially synthesized oligonucleotide primer
tagcctgcccacctcaggat

SEQ ID NO: 159 - protein, 41 aa, Artificial Sequence
  Artificially synthesized BCL6 peptide inhibitor
  MISC_FEATURE (2)..(10): The amino acid in this position is in the D-isomer form
  MISC_FEATURE (13)..(20): The amino acid in this position is in the D-isomer form
  MISC_FEATURE (23)..(25): The amino acid in this position is in the D-isomer form
  MISC_FEATURE (27)..(28): The amino acid in this position is in the D-isomer form
  MISC_FEATURE (30)..(33): The amino acid in this position is in the D-isomer form
  MISC_FEATURE (35)..(37): The amino acid in this position is in the D-isomer form
  MISC_FEATURE (39)..(40): The amino acid in this position is in the D-isomer form
GRRRQRRKKRGGRGIEHAARGGDIMGEWGNEIFGAIAGFLG

SEQ ID NO: 160 - protein, 9 aa, Artificial Sequence
  Artificially synthesized BCL6 peptide inhibitor
GRGIEHISR

SEQ ID NO: 161 - protein, 10 aa, Artificial Sequence
  Artificially synthesized BCL6 inhibitor
GRGIEHISRG

SEQ ID NO: 162 - protein, 6 aa, Artificial Sequence
  Artificially synthesized BCL6 inhibitor
  MOD_RES (2)..(2): PHOSPHORYLATION
PYLKTK

SEQ ID NO: 163 - protein, 6 aa, Artificial Sequence
  Artificially synthesized BCL6 inhibitor
  MOD_RES (1)..(1): PHOSPHORYLATION
YLPQTV

SEQ ID NO: 164 - protein, 747 aa, Homo sapiens; identical to SEQ ID NO: 118

What is claimed is:

1. A method for increasing the likelihood of implantation of an embryo in a subject with decreased endometrial receptivity due to overexpression of a SIRT1 protein and a BCL6 protein, comprising treating the subject having overexpression of a SIRT1 protein and a BCL6 protein by surgical removal of some or all of any endometriosis in the subject, administration to the subject of an effective amount of a gonadotropin-releasing hormone (GnRH) agonist, or any combination thereof.

2. A method for managing recurrent pregnancy loss in a subject with decreased endometrial receptivity due to overexpression of a SIRT1 protein and a BCL6 protein, comprising treating the subject having overexpression of a SIRT1 protein and a BCL6 protein by surgical removal of some or all of any endometriosis in the subject, administration to the subject of an effective amount of a gonadotropin-releasing hormone (GnRH) agonist, or any combination thereof.

3. A method for treating a subject with decreased endometrial receptivity due to overexpression of a SIRT1 protein and a BCL6 protein and at increased risk for implantation failure subsequent to in vitro fertilization (IVF) and/or frozen embryo transfer (FET), comprising treating the subject having overexpression of a SIRT1 protein and a BCL6 protein by surgical removal of some or all of any endometriosis in the subject, administration to the subject of an effective amount of a gonadotropin-releasing hormone (GnRH) agonist, or any combination thereof.

4. A method for increasing the likelihood of implantation of an embryo in a subject with decreased endometrial receptivity due to overexpression of a SIRT1 protein and a BCL6 protein, comprising:
   a) obtaining a sample from the subject;
   b) determining a level of expression of a SIRT1 protein in the sample;
   c) determining a level of expression of a BCL6 protein in the sample;
   d) comparing the level of expression determined in (b) with the level of expression of a SIRT1 protein in a sample obtained from a control subject or a population of control subjects;
   e) comparing the level of expression determined in (c) with the level of expression of a BCL6 protein in a sample obtained from a control subject or a population of control subjects;
   f) diagnosing the subject as having decreased endometrial receptivity due to overexpression of a SIRT1 protein and a BCL6 protein when the subject has a level of expression of the SIRT1 protein greater than the level of expression of the SIRT1 protein of the control subject or population of control subjects and also has a level of expression of the BCL6 protein that is greater than the level of expression of the BCL6 protein of the control subject or population of control subjects; and
   g) treating the subject having overexpression of a SIRT1 protein and a BCL6 protein by surgical removal of some or all of any endometriosis in the subject, administration to the subject of an effective amount of a gonadotropin-releasing hormone (GnRH) agonist, or any combination thereof, thereby increasing the likelihood of implantation of an embryo in the subject.

5. The method of claim 4, wherein the step b) determining a level of expression of a SIRT1 protein in the sample further comprises calculating an HSCORE for the subject based on the level of expression of the SIRT1 protein determined in (b), wherein the step c) determining a level of expression of a BCL6 protein in the sample further comprises calculating an HSCORE for the subject based on the level of expression of the BCL6 protein determined in (c), and wherein the step f) diagnosing the subject as having decreased endometrial receptivity due to overexpression of a SIRT1 protein and a BCL6 protein when the subject has an HSCORE calculated for a level of expression of a SIRT1 protein that is greater than a pre-determined cut-off value, and an HSCORE calculated for a level of expression of a BCL6 protein that is greater than a pre-determined cut-off value.

6. The method of claim 5, wherein the HSCORE is calculated using the following equation: HSCORE=ΣPi(i+1)/100, where i=the intensity of staining of cells in the sample with a value of 1 being low staining, 2 being moderate staining, and 3 being strong staining, and Pi being the percentage of stained cells in the sample for each intensity, varying from 0-100%.

7. The method of claim 6, wherein the pre-determined cut-off value is selected from the group consisting of 1.0, 1.1, 1.2, 1.3, 1.4, 1.5, 1.6, 1.7, 1.8, 1.9, and 2.0.

8. A method for managing recurrent pregnancy loss in a subject with decreased endometrial receptivity due to overexpression of a SIRT1 protein and a BCL6 protein, comprising:
  a) obtaining a sample from the subject;
  b) determining a level of expression of a SIRT1 protein in the sample;
  c) determining a level of expression of a BCL6 protein in the sample;
  d) comparing the level of expression determined in (b) with the level of expression of a SIRT1 protein in a sample obtained from a control subject or a population of control subjects;
  e) comparing the level of expression determined in (c) with the level of expression of a BCL6 protein in a sample obtained from a control subject or a population of control subjects;
  f) diagnosing the subject as having decreased endometrial receptivity due to overexpression of a SIRT1 protein and a BCL6 protein when the subject has a level of expression of the SIRT1 protein greater than the level of expression of the SIRT1 protein of the control subject or population of control subjects and also has a level of expression of the BCL6 protein that is greater than the level of expression of the BCL6 protein of the control subject or population of control subjects; and
  g) treating the subject having overexpression of a SIRT1 protein and a BCL6 protein by surgical removal of some or all of any endometriosis in the subject, administration to the subject of an effective amount of a gonadotropin-releasing hormone (GnRH) agonist, or any combination thereof.

9. The method of claim 8, wherein the step b) determining a level of expression of a SIRT1 protein in the sample further comprises calculating an HSCORE for the subject based on the level of expression of the SIRT1 protein determined in (b), wherein the step c) determining a level of expression of a BCL6 protein in the sample further comprises calculating an HSCORE for the subject based on the level of expression of the BCL6 protein determined in (c), and wherein the step f) diagnosing the subject as having decreased endometrial receptivity due to overexpression of a SIRT1 protein and a BCL6 protein when the subject has an HSCORE calculated for a level of expression of a SIRT1 protein that is greater than a pre-determined cut-off value, and an HSCORE calculated for a level of expression of a BCL6 protein that is greater than a pre-determined cut-off value.

10. The method of claim 9, wherein the HSCORE is calculated using the following equation: HSCORE=ΣPi(i+1)/100, where i=the intensity of staining of cells in the sample with a value of 1 being low staining, 2 being moderate staining, and 3 being strong staining, and Pi being the percentage of stained cells in the sample for each intensity, varying from 0-100%.

11. The method of claim 10, wherein the pre-determined cut-off value is selected from the group consisting of 1.0, 1.1, 1.2, 1.3, 1.4, 1.5, 1.6, 1.7, 1.8, 1.9, and 2.0.

12. A method for identifying an increased risk for implantation failure subsequent to in vitro fertilization (IVF) and/or frozen embryo transfer (FET) in a subject with decreased endometrial receptivity due to overexpression of a SIRT1 protein and a BCL6 protein and treating the subject, comprising
  a) obtaining a sample from the subject;
  b) determining a level of expression of a SIRT1 protein in the sample;
  c) determining a level of expression of a BCL6 protein in the sample;
  d) comparing the level of expression determined in (b) with the level of expression of a SIRT1 protein in a sample obtained from a control subject or a population of control subjects;
  e) comparing the level of expression determined in (c) with the level of expression of a BCL6 protein in a sample obtained from a control subject or a population of control subjects;
  f) diagnosing the subject as having an increased risk for implantation failure subsequent to IVF and/or FET when the subject has a level of expression of the SIRT1 protein greater than the level of expression of the SIRT1 protein of the control subject or population of control subjects and also has a level of expression of the BCL6 protein that is greater than the level of expression of the BCL6 protein of the control subject or population of control subjects; and
  g) treating the subject having overexpression of a SIRT1 protein and a BCL6 protein by surgical removal of some or all of any endometriosis in the subject, administration to the subject of an effective amount of a gonadotropin-releasing hormone (GnRH) agonist, or any combination thereof.

13. The method of claim 12, wherein the step b) determining a level of expression of a SIRT1 protein in the sample further comprises calculating an HSCORE for the subject based on the level of expression of the SIRT1 protein determined in (b), wherein the step c) determining a level of expression of a BCL6 protein in the sample further comprises calculating an HSCORE for the subject based on the level of expression of the BCL6 protein determined in (c), and wherein the step f) diagnosing the subject as having an increased risk for implantation failure subsequent to IVF and/or FET when the subject has an HSCORE calculated for a level of expression of a SIRT1 protein that is greater than a pre-determined cut-off value, and an HSCORE calculated for a level of expression of a BCL6 protein that is greater than a pre-determined cut-off value.

14. The method of claim 13, wherein the HSCORE is calculated using the following equation: HSCORE=ΣPi(i+1)/100, where i=the intensity of staining of cells in the sample with a value of 1 being low staining, 2 being moderate staining, and 3 being strong staining, and Pi being the percentage of stained cells in the sample for each intensity, varying from 0-100%.

15. The method of claim 14, wherein the pre-determined cut-off value is selected from the group consisting of 1.0, 1.1, 1.2, 1.3, 1.4, 1.5, 1.6, 1.7, 1.8, 1.9, and 2.0.

* * * * *

UNITED STATES PATENT AND TRADEMARK OFFICE
CERTIFICATE OF CORRECTION

PATENT NO. : 11,474,105 B2
APPLICATION NO. : 16/090066
DATED : October 18, 2022
INVENTOR(S) : Young et al.

It is certified that error appears in the above-identified patent and that said Letters Patent is hereby corrected as shown below:

On the Title Page

(60) Related U.S. Application Data: Please correct "62/471,815" to read --62/471,915--

In the Specification

Column 10, Line 20: Please correct "mean SEM" to read --mean ± SEM--

Column 52, Line 47: Please correct "(Cell Signaling)" to read --(Cell Signaling).--

Column 52, Line 47: Please insert a paragraph break beginning with "Cell Culture"

Column 63, Line 3: Please insert a paragraph break between "endometrium." and "The"

Signed and Sealed this
Fourteenth Day of February, 2023

Katherine Kelly Vidal
*Director of the United States Patent and Trademark Office*